United States Patent 8,105,776 (BREED-SPECIFIC HAPLOTYPES FOR POLLED PHENOTYPES IN CATTLE) - sequence listing, part 2

SEQ ID NO: 43 - DNA, 3000000 bp, Bos taurus (residues 1,500,001-3,000,000 of 3,000,000)
  modified_base (3268)..(3767): a, c, g, t unknown or other
  modified_base (179664)..(179713): a, c, g, t unknown or other
  modified_base (194312)..(194640): a, c, g, t unknown or other
  modified_base (195971)..(196020): a, c, g, t unknown or other
  modified_base (296357)..(296610): a, c, g, t unknown or other
  modified_base (324054)..(324103): a, c, g, t unknown or other
  modified_base (564168)..(574167): a, c, g, t unknown or other
  modified_base (577234)..(577283): a, c, g, t unknown or other
  modified_base (842726)..(843408): a, c, g, t unknown or other
  modified_base (848893)..(849548): a, c, g, t unknown or other
  modified_base (1004164)..(1004213): a, c, g, t unknown or other
  modified_base (1035786)..(1045785): a, c, g, t unknown or other
  modified_base (1474297)..(1474346): a, c, g, t unknown or other
  modified_base (1565394)..(1565890): a, c, g, t unknown or other
  modified_base (1605625)..(1605674): a, c, g, t unknown or other
  modified_base (1649773)..(1649822): a, c, g, t unknown or other
  modified_base (2484044)..(2484093): a, c, g, t unknown or other
  modified_base (2510646)..(2510695): a, c, g, t unknown or other
  modified_base (2554495)..(2554622): a, c, g, t unknown or other
  modified_base (2608163)..(2608212): a, c, g, t unknown or other
  modified_base (2613886)..(2613935): a, c, g, t unknown or other
  modified_base (2630148)..(2630148): a, c, g, t unknown or other
  modified_base (2630151)..(2630151): a, c, g, t unknown or other
  modified_base (2630165)..(2630165): a, c, g, t unknown or other
  modified_base (2630167)..(2630167): a, c, g, t unknown or other
  modified_base (2630174)..(2630174): a, c, g, t unknown or other
  modified_base (2630188)..(2630188): a, c, g, t unknown or other
  modified_base (2630190)..(2630190): a, c, g, t unknown or other
  modified_base (2630192)..(2630192): a, c, g, t unknown or other
  modified_base (2630195)..(2630195): a, c, g, t unknown or other
  modified_base (2630314)..(2630314): a, c, g, t unknown or other
  modified_base (2630340)..(2630340): a, c, g, t unknown or other
  modified_base (2630349)..(2630349): a, c, g, t unknown or other
  modified_base (2630357)..(2630359): a, c, g, t unknown or other
  modified_base (2630362)..(2630362): a, c, g, t unknown or other
  modified_base (2630366)..(2630369): a, c, g, t unknown or other
  modified_base (2630374)..(2630374): a, c, g, t unknown or other
  modified_base (2630379)..(2630379): a, c, g, t unknown or other
  modified_base (2630389)..(2630389): a, c, g, t unknown or other
  modified_base (2630391)..(2630393): a, c, g, t unknown or other
  modified_base (2630405)..(2630406): a, c, g, t unknown or other
  modified_base (2630433)..(2630433): a, c, g, t unknown or other
  modified_base (2630436)..(2630437): a, c, g, t unknown or other
  modified_base (2630445)..(2630445): a, c, g, t unknown or other
  modified_base (2630453)..(2630453): a, c, g, t unknown or other
  modified_base (2630460)..(2630460): a, c, g, t unknown or other
  modified_base (2630463)..(2630463): a, c, g, t unknown or other
  modified_base (2630468)..(2630469): a, c, g, t unknown or other
  modified_base (2630481)..(2630482): a, c, g, t unknown or other
  modified_base (2630485)..(2630486): a, c, g, t unknown or other
  modified_base (2630525)..(2630525): a, c, g, t unknown or other
  modified_base (2630527)..(2630529): a, c, g, t unknown or other
  modified_base (2630535)..(2630539): a, c, g, t unknown or other
  modified_base (2630541)..(2630541): a, c, g, t unknown or other
  modified_base (2630543)..(2630543): a, c, g, t unknown or other
  modified_base (2630546)..(2630547): a, c, g, t unknown or other
  modified_base (2630550)..(2630552): a, c, g, t unknown or other
  modified_base (2630563)..(2630564): a, c, g, t unknown or other
  modified_base (2630569)..(2630569): a, c, g, t unknown or other
  modified_base (2630571)..(2630573): a, c, g, t unknown or other
  modified_base (2630577)..(2630579): a, c, g, t unknown or other
  modified_base (2630583)..(2630583): a, c, g, t unknown or other
  modified_base (2630586)..(2630588): a, c, g, t unknown or other
  modified_base (2630594)..(2630594): a, c, g, t unknown or other
  modified_base (2630596)..(2630596): a, c, g, t unknown or other
  modified_base (2630598)..(2630598): a, c, g, t unknown or other
  modified_base (2630601)..(2630602): a, c, g, t unknown or other
  modified_base (2630604)..(2630605): a, c, g, t unknown or other
  modified_base (2630607)..(2630609): a, c, g, t unknown or other
  modified_base (2630612)..(2630617): a, c, g, t unknown or other
  modified_base (2630621)..(2630622): a, c, g, t unknown or other
  modified_base (2630624)..(2630624): a, c, g, t unknown or other
  modified_base (2630638)..(2630639): a, c, g, t unknown or other
  modified_base (2630641)..(2630641): a, c, g, t unknown or other
  modified_base (2630644)..(2630644): a, c, g, t unknown or other
  modified_base (2630646)..(2630650): a, c, g, t unknown or other
  modified_base (2630653)..(2630655): a, c, g, t unknown or other
  modified_base (2630657)..(2630657): a, c, g, t unknown or other
  modified_base (2630659)..(2630660): a, c, g, t unknown or other
  modified_base (2630663)..(2630666): a, c, g, t unknown or other
  modified_base (2663609)..(2664095): a, c, g, t unknown or other
  modified_base (2684778)..(2684827): a, c, g, t unknown or other
  modified_base (2731473)..(2733317): a, c, g, t unknown or other
  modified_base (2737123)..(2737172): a, c, g, t unknown or other
  modified_base (2813564)..(2813613): a, c, g, t unknown or other
  modified_base (2884420)..(2884420): a, c, g, t unknown or other
  modified_base (2884531)..(2884580): a, c, g, t unknown or other
  modified_base (2916466)..(2916515): a, c, g, t unknown or other
  modified_base (2930067)..(2930116): a, c, g, t unknown or other
  modified_base (2937958)..(2968019): a, c, g, t unknown or other
  modified_base (2998669)..(2998916): a, c, g, t unknown or other
tgactttctattcaaataaccagtacaaggcaagcgggcgggatggtgaggctgagtagctggagtgtcttcaccctgtaggtaggagctgtgcctgatgacccacctcagattctgatacaggaatttccagtgtgtgcaaagagggtaaatgacccaggatttaaatgatacagtgtaattatgcagaactgttgttgtttagtcattaagtcatgtatatgactctttgtgaccacatggactgcagcacgccacgctcctctgtcctccactctctccccaagtttgctcagattcatgtccattgagttggtgatattatttgatatctaatcacctcatccttatgaagaatagtgacaggcaattcttgttctgcttgggtttctataacaaaataccaaaggctgagtagtttaaacaatagaaatgtatttgtcattattctagaaactgaggagtccaagatcaaggtgctggcaagatgagtttcattctgaggtctctttccttgacttacaggggactaccatcttgttacatactcctatgaccctcttctttgtgtgtgagctcaagtggggagagagaacaagctctctggtgtctcttccttttcttataagggcactaattacatcatgagggcctcaccctcatgacttttttaaccccagtcactttccaaaggtcccacctccaaataccatcacatcagggtttagggcaacaacttacaaattctacagggcagcagggacacaaacattagtccataataacagtggatgtacaatgaaattgctaacctacctaaaggtcaaccctgttactatcccttttcacatctgatcaatcatctgagaatttgaggagataatgtgaaatgtaggagtatgtagattgtgcttactgagttcaagaggttggatgggaagcgaagcaaagtgaaagttgctcagtcatgtccaactgtttgtgaccttatggactatgcagttcatggaattctccaggccagaatactggagtgggtagcctttcccttctccaagggatcttcctagcccagggatagaacctgagtctcattgcgacagcaaccatgtctggtcgtgggaagggtggcaaaggccttggcaaggggggtgctaagcgccatcgcaaagtcttgcgggacaacattcagggtattactaagccagctatccggcgtctggctcgtcatggaggcgtcaaacgtatctctggtcttatctacgaagagactcgtggggtgctgaaagtgtttctggaaaatgtgatccgggacgcggtcacctatatggagcacgctaagcgcaagactgttaccgccatggatgtggtctacgcgctcaaacgtcagggctgtaccctttacggttttggtggttgagcaaagcatctagcttgaaacgtttagaaaaactaaaggcccttttcagggccgcagaaaaaaaaaaaaagaacctgagtctcctgcattgcagacggattctagatttcacgtactgagttcaaggagttggctatatttcataattccatcttatggtctttggtgtagagacttgaattcagagattgcaaatgagataatgaaaaaacaagttggcatttaaatattacaagatttcacataaacttctagatttattacttttcttgaaaccttgcaagacctggttcagtgatgatatgcatgaaaaagaggctctttcatcaattaattgagcagatcaattaattaatcaattgttgctgttgttcaaacaacagggagggaacacagccctgatcatcaacaaaaaattggattaaagacttactgagcatggccctgcccatcaaaacaagacccagtttcccctacagtcagtctctcccatcaggaagcttccataaaccttattctgtcagaaggtggacagaatgaaaaccacagtcacagaaaactaatcaaactgatcacgtggaccacagccttgtctaattcagtgaacctatgagccatgctgtgtagggccacctaagacagacaggtcatagtggagagttcttacaaaacgtggtccactggagaagagaatggcaaaccacttcagtattctgccttgagaaccccatgaacagtatgaaaaggcaaaaagatatgacactgaaagatgatctcctcaggttggtaggtgcccaatatgctactggagaagagtggagaaataaagcatgaagatacggagccaaagcaaaaacaatgcccagttgtggatatgactggtgatagaagtaaagtccgatgctgtaaagagcaatatcgcataggaacctagaatgtcaggtccaggaatcaaggtaaattagaagtggtcaagcaggagatggcaagagtgaacgttgacattttaggaatcagtaaactaaaatggactggattgggtaaatttagttcagatgaccattatatctactactgtgggcaagaatcccttggaagaaatggagtagctctagtagtcaacaaaagagtccaaaatacagtacttgggtgcaatctcaaaaatgacagcatgatctctgttcatttccaaggcaaaccattcagtatcacagtaatccaagtctatgctccaaccagtaaagctgaagaagctgaaattgaacagttctatgaagacctgcaagaccttctagaactaacaccccaaaaagatgtccttttcatcacaggggactagaatgtaaaagtagaaagtcaagagatacctggaataacaggcatttttggccttggagtacaaaatgaagcagggcaaagactgacagagttttgccaagagaatgcaccagtcatagcaaacacaagagaagactctacacgtggacatcaccagatggtcaatactgaaatcagattggttatattttttgcagccaaagatggagaagctctatacggtcagcaaaaataagaccaggagctgatagtggctcataccatgaactccttattgccaaattcagacttaaattgaagaaagtagagaaaaccactagaccattcaggtatgacctaaatcaaatcccttatgattatacagtggaagtgacaaatagattcaaggaattagatctgatagacagagtgcctaaagaactatggatggaggttcatgacattgtacaggaggcagtgatcaagaccatccccaagaaaaagaaatgcaaaaaggcaagatggttgtctgaggaggccttacaaatagctgagaaaagaagagaagggaaaggccaaggagaaaaggaaagatatactcatttgaatgcagagtttcaaagaatagcaaggagagataagaaagccttcctcagtgatcagtgcaaagaaatagaggaaaacaatagaatgggaaagactagagatctcttcaagaaaattagagatatcaagggaatagttcatgcaaagaggggtgtaataaaggacaaaaatggtatagacctaacagaagcagaagatattaagtggtgagaatacccagaagaactatacaaaaaacattttcatgacccagataaccacagtgatgtgatcactcacctagagccagacatcctggaatgcgaagtcaagtgggtcttagaaagcatcactatgaacaaagctagtggaggtgatggaattccagtggagctatttcaaatcctaaaagatgatgctgtgaaagtgctgcactcaatatgccagcaaatttggaaaagtcagcagtggccacaggactggaaaagctcagttttcactccaatcccaaagaaagacaatgccaaagaatacttcaactactgaaaaattgcactcatctcacatgctagcaaagtaatgctcaaaattctgcaagccaggtttcaaaaatatgtgaaccatgaacttccagatgttcaaactggatttagaaaaggcagagaaaccagagatcaaattgccaacacctgttggatcatcgaaaaagtaagagagttccagaaaaacatctacttctgctttattgactacaccaaagcctttgactgtgtacatcacaaccaactgtggaaaattcttaaagagatgggaataccagaccactttacctgcctcctgagaaatgtgtatgcaggtcaagaagcagcagttagaactggacatggaacagcagactggttccaaattgggaaaggagtacatcaaggctgtatattgtcacctgcttatttaacttatatgcagagtacatcatgtggaatgccaggctggatgaaacacaagctggaatcaagattgctgggagaaatatcagtaacctcagataggcagatgataccacccttatggcagaaagtgaaaaggaactagagagcctcttgatgaaagtgaaagaggagagtggaaaaagttggcttaaagctcaacattaagaaaaatgaaggtcatgtcatctggtcccatcacttcatggcaaatagatggggaaacaatggaaacagtgacagatgttattttcttgggctcctaaatcagtgcagatggtgactgcagccatgaaattaaaagatgcttgctctttagaaggaaagttatgaccaacctagacagcatattaaaaagcagagacaatactttgccaacaaaggtccatctagtcaaggctatggtttttccagtggtcatgtatgaatgtgagaggtagaccatagagaaaactgaacaccaaagagttgatgctcttgaactgtggtgttggagaagactcttgagagtcccttggactgcaaggagatccaaccagtccatcctaatggaaatcagtcctgaaaattcattggaagtactgatgctgaagctgcaactccaatactttggccacctgatgcaaagagctgacgtattggaaaagaccctgatgctgggaaacattgagggcaggaggagaaggggacgacagaggatgagatggttggatggcatcactgactcagtggacattgagtttgagtagcctccaggagttggtgatggacagggaggcctggcgtgctgcagtccatggggttgcaaaaatttggacatgactaaatgaatgaattgaactgaactgatcaattaattttgcttaacatgaaacaggaaatctccttagaaactttaaaagtatattaatgtgaaagactctgaaaagtcttaaaggtgttcgcttaatcttgtctaaccgcttgtttctcaaatatatttggaacctctttttacagggaagaatggctgaagtcattgaaagctgcccacttctgttcattctagtctccacctgtcttcagtgggactccctgggtaaccaactgagagggggatttgtagtcaggattattttggagagtggtctcaggaacatggccccatgtggcgcagtggtaaagaatccccatgccaatgcaagagacgcaggtttgattcctgattcaggaagatcccccggagagggtaatggcaaccctccagtattcttgcctgggaaatcccaaagacagaagaacctggtgggctatcgtccatggggtcacaaacagataacaacaactctggatcgttactggtaatggcaggaaggaggaaggattgattggagaaactgaataacagtgaggtgaatcagtcacaaccaaggtctcggcccgtcccagaggaggaggtaagatggtctttcaggcctgtcgtgtctcaagagaatggaggcagaactttatatcccactttgaccatccctggacatgggctatccccaggaaggggtgtgaccttgggcaaaatggcagttttcagctgaggacggttcccagagaatgactttgcagagcgccaccagcatccacagtccgagcagtgtgttcatcccatagggcatctgggcagcataccacagtaaccactacaccaccaccccattacctccctgagcctgaagccagggtcatttgtcatttgtagttgcccttgaactgttgtttgtctgatggtagagattgtttctcttttacctatgactctagcaggatttgcgcttcccaggtggctcagtagtaaagaatctacttgcaatgcaggagacacagattccatcgttaggtcaggaagatcccctggaggagaaaacggcaacccactccagtattcttgcctgggaaaccccatggacagagaagcctggcaggttgcagtccaaggggttgcaaagagttggacacaactccgtgactgagcatgcatgccgttagcagaagtgacaacagaatacccagggaaagctgtctctttcaagaaaaatgggcgaagacattggtccttttggaagtgaagaatattcattcctgtgtaactgatttgcaaacactccacccactccattcatccatatcatatgccggccaccataaatatttgagtgcatgcctggggaatgcttgggcctggctaggagtccgaggggcaattagttcaaccagaaccaaggttcctctgactgcactgctcttcacatctgtccctaagatggaccaggcctgactggaagggctttttaatggagttcctctagaggcactgattctgcagagtttgcaatggattcttttagtgtcctgttgtcatgtgacatatttctgtgcagcacatcaccccaaaatttagtggctggcttcaaacaataacaacgtactagttccccgggttctatggtttaagagctgagaaggggcttagcaggctactctgctccaggcaatgtcagatcggatcatatatgtggctgcatccagttgaggctgaaatgtccaaaatacccactcatccccctgtcctctctctacacggcttcaccatccaggactccgccttatgacatagcagatgagcagcgagagcaaaggacccggaatgggtgccaggtgactccgcccctgtgttattggtcaatgccgctcttaagaccagctcagagtcaatgggagaagctgaaatagactccacccctcaatggaggcgcaggaagagaggatggccatcttaaatgcactatagtgacaaccctctcattcctatagatttctgatgaatcgttattagaagcagctttttttaaaaaggggcatatactcatccctttcatgtaccctgagtctggaagcacacttttgggaaactctttccaaaatactcttctacagacatagagagatgggctgtctcctgggagggttttttctatgccaccctaggtaggagtcaacaggtgtgtgaatttcagcatcaggaggccttgctgtttggcttcactgctgctgctgctaagtcgcttcagtcgtgtccgactctgtgcgaccccagagacggaagtccaccaggctccgccatccctgggattctccaggcaagaacactggagtgggttgccatttccttctccagtgcatgaaagtgaaaagtgaaagtgaagtcgctccgttgtgtccgactcttcgtgacctcatggactgcagcctaccaggctcctctgtccatgggattttcgaggcaagagtactggaatggggtgccattgccttccccattttgtttcacatcccctgcctaactccattagcttctcccagttgtgaccatcaccatcgccatcatgtcaccattattcatcatcagggcaggccctttattaggcacccaatggcttgtccagtggtgctgggagatggagtgcaaatacaggaaggctcagagcaggcctgcctggggtgatgcccaaggctgaattggaggttccagaacccctacggaggccacacaggccagaacatgaaggttgaatgagcaccgcaatgcatagccaggggctcacaccatgtaagctcaacagaggcgacaggatcagaggaccacagcatagcactttttttttcttcttctgaaatttaattttcattttatcttggaatatagttgatttacaatatcatgttcattttaggtatatagcaaagtgattcaattatgcatatacatacatccattctttttcaggttcatttaccatataggtcattacagagtattgagtagagttccccatgttatatagtaggtccttgttgattatctgttttgtatagagcagtctttatatgctaatttcaaactcctagtttatcccccatcctccgcaccaaacagcattgcattttgccttcaagttctcctggtcctgctggttattggggctccagttcagttgtcagaaaattaattcacagaaaaactctttgcagaaactgggaaatagattcctcagtctgggtctgaacagattttggcttctccaccgaaagcagagacacactaggggcaggacgtccgtctgcagacagagaggacagggaaactcatacacagggccgaactcatgcgttcatatgtaaaaacgtgatgggcaagtgcttgacccagaaacgcgaagccgcagcagggccaacatacagctgtgctgggccaacggattaactgcagtgaaaagactggaacggaactctagtgaatctacagggagatgaagacttccatacatcatctgtcaattcagcaagttactgagttgatcactcggctagtgcatgatgcggctggcagctttttgcaactcagcgcatttccacgtgccacttgagaccccgagcacattttctcattggagatgaccagttagttgctacctcacaaggtaaggcgaggtaggagaaagtactttggaaaatgtaaagtgtgtaaaaatattagtctttacaaacagaaacagactcacaggtttcaagaacgagcttatggttgccgggagaagagaaggctgggtagggggtaggcatagttagggagtttgggatggacatgtacacactgctgtatttaaactggataacgaacaaggaccagctatatagcacagggaactctgctcaatgttgtgcggcagtctggatgggagaggagtttggggagaatggatacctgtatctatacggctcaggcccttcactgttcccccaaaactattaatagccaacactgtatgttaatcggctataccccaatacaaaataaaaaagttaaaaaaattagtctttcaagagaggaaatagatggggaaacagtggaaacagtggcagactttatttttggggctccaaagtcactgcagatggtgactgcagccatgaaattaagagatgtttgcttggcaggaaagttatgaccagcctagatagcatattaaaagcagagacattactttgccaacaaaggtccgtctagtcaaggctatggtttttccagtggtcatgtatggatgtgagagttggactgtgaagaaagctgagcaccgaagaattgatgcttttgaactgtggtgttggagaagactcttgggagtcccttggactgcaaggagatccagccagtccatcctaaaggagatcagtcctgggtgttcattggaaggactgatgctgaagccgaaactccaatgctttgaccacctgatgcgaagagctgactcattggaaaagaccctgatgctgggaaaggtgggaggagaaggggatgacagaggatgagatggctggatggcatcactgacttgatggacatgagtctgagtaaactccaggagttggtgatggacagggaggcctggcatgctgcagtccatggggtcacggagttggacacgactgagcgacaactgaactgaactgaaagagaggagaaggctgtggcagaggatgagatggttggatagcatcactgactcaatgaacatgaatctgagcaaactccaggaaatagtggaggacaggggagcctggcaagctatagttcatggggtcccaaagagtcgggcataacttagcagctgaatagcagcaacaacaaaagagaggactaagtacattttagcagtggtcagtgtaaagataagttcacagaaaaactggagtggatcacactgacctgggaagagtgtgtgtgtgtgtgtgtgtgtgtgtgtgtgttggtcactcagtcatgtccaactctttgggactccatggactgcagcccaccatgttcctctgtccatggaatgctccagggaagaatatgggaatgggtagccattcctttctccaggtggtcttcccaacccagggatgcaacccaggcctcctttagtgcaggcaggttctttatcatttgagccaccagggaagcctggggacagcgtggaaccacctcatatggctctcatcttctaggtctctctctgcatcagaagcagtttctgctcctccgggggagattccatggtacaaataggctttcaggaacttcctactgtgatgtctgatgaaaaacaggcctttgggtttcaaaagccaatccttggtgaggaatggaactgatgcagctgtagctctcagatctaggagagggataatgatgtaagaacccagaccccttccttctgaattagaaaaggattctcgtggctgtagggaaaggataataggagaagtgagtgcatgaatatttgcggtccctgagagaaaaagggtcctctacccctcttccccactggctgaatccagatgggtcttaagagaaaggtctatgggctggatgaggacagggcttggctacgtgctccagattctagcagaggcagcaagtgcccagagagaaatgagattgtgggtgtcagcaggcatgtaggtggtccctgctttaggagcctcacaatgtcccctggaaggccaagggctacatgatccggcagctggagcagaggtgacaaaagcccagatgcatgcaccctcctttcctgtcacctgggggccctaggagcctcctcctccccagataggaatggctcctggaggaaatttacccaggaagtggactgaggtgcctttctgccagctgaatggggccttgaaagagaattcaggtgacactcctgttgtagacaaggggcctctctggtagctcagtggtaaagaatacgcctgccaatgcagaagacaccagtttgatattggggtcaggaagatcccctggagaaggaaatggcaacccactccagtgttcttacctggagaatcccatggacagaggagcctagctatctacagtccatagtgtggcaaagagttggtcacgacttagtgactaaacaacaacaaccctgttgtataataaagtgtttggctggctttcatttttagttcataagaaggagtctctaattctttggaatttcccaggtgacaggagagcctttgttactcatgagcctcttggatcacacctgagtttatactaagagttatgatgacccaaggataggacacaagaaagaccaatcatgtgatgagagttggggtctggccggtctgaccttggcaggggtaggggtggggagggagagggagagagggagggaggtgggagattgattgcccacatgggcaatgagtcagtctatcaggctgacgtaatgagattccggtgaaaaactctggactttgaggctggatggagtttggtggctggcgatctcattgacgttccaggagggtggtgtgcctgcgtccacagggaggaccacagggaggaccacagaagctctgcatctggacttctcagacctttgcctatgtgagcattcacttggctgggcctggcctggctcttttataataaaacagtgattgtaagtagagcaccttcctgggtcctgtgagtcctcctggggaattactaaacccgaggggttgtgggaagctctgaatttgtagccagtctcagaagtgtggatggcctgggacccccccaggagtgtggccagagtgtgagggaagggctgtcctgtggaggacccagactttaactcggggtgcagtgggccagggtggggaagtgactggctagtcgtgctagaactgtgttgcagttggtggcagaagaattaccaaagactaaagttgcacactcacaaaaggagatgtgagtacctcctagggttggtttcaagaagcaagaagaggcagggaaagctattctcatggtgcttgggacatagaagatctcagtcagtgtctacatttattgtttactgttaatctaatttttggggaaaagtccactctttctcaagattatggttccttcttctcccagatcacctttatttatttatttttttttcatggtgagaggaggacgtggggagggggactggaaggattcttggaatattcctcttcagttcttgttttgcttccatgatcatttgttcacttattaattttttctcacgaataatccctgatatcataggtaagaagaggtcaggagaccagggggaggcttcgggaagaatccagacatcacactgtggtggcccggatagaggtgtgagaagtggtcatattttggatatattttctttctttttttttcctagtcctttaaaaaataattttatttatggctgtgctgggtctttattgctgtgcagacttttctctagttgctgctaggtgaggtgacagtccagttgtggtgtgaaggctcctcgctgtgggagcttcttttgtggtggagcatacactctagggtgttcaggcttgtggcacgtgggctcagtaattgtagtgcttgggcttagtagctctgaggcatcttcctggcccagggatcgaatccgtatctcctgcattgtcaggcaaattctttaccactgagccacctgggaaacccctttctttctagttttattgcttgagtacaacagacaagtttatgcaatcaagccaaaggctgcagatgcgtatttccggttgaggggaaggacttgtttggtcttgtaatatccagcccaccagtgaatagggctgtcaatcagaatcagatgcaattgagcatctttatcctttcttttcctctcaagatgctttcaaaccgcaatggctttcttaattaaatggtagagatcctcaggaaaatcaggagcaagtcctttagacttaagaattctcaagattttattgcctgtcacagaatgtactgtgtaacagcatgtgagtctctgaggaccaccccgattcgtgagggagtcaggctcttcttgaccagtttgtaggtctgctccttcatgacctcaggcgtcagcttcagccaggtggggaccctgtgacggggggacagaaccaactgggacaggcctttccggggagcgtgcatgcaacccatgatggaggcagtctggtgccaaaggagagagatacgctttcaagtttaggatttgccgacagattggatgcagggttagagagagagaggaagatgcctcccaggttttggcctaagtcacagctgccactcactgagatgggaaaggttgcagtgaccttttggggaccatctgctagtcctgcaaagtcacagcctgtttgatcgttcccaggtgggtttatcactttttatttttttaccaaattgaaggcaggaggagaaggggacgacagaggatgagacggttggatggcatcactgactcaatggacacgagtgtaagcaaactctgggagatggtgatggacagggaggcctggcatgctgtagtccatggggtcgcaaagagtcgtacatgactgagcgactgaacagcaacgatttttaccgaaatggcccggtttgttccagcctttggtggaacttcccatggagagctccgtctttacagacaaatcaactgctttcgataaggctgatgtttggttggtccatggagcgctccttcacaatcattcattttgagtgtttatttggaaagtgtgtatatggatacatttaatgtggtggcgattgaaaacaaattttaattttaggtccagtctttggagttgaactctgtttttcacatggcttctgtctcagtgataaaaaaaataataataaatgtgcaatttttttctttcttaattgaaacatacttgacatgtgatactgtgtaggtttcagttgcgtaacatgttgatttgatccatatatatattgtaatacaattgccactgtagtgtcagttgacacctctatggcatcacatagttatttctttttttttgtggtgagaatatttacgatatagtctctgagcaaatttgatatttctaataaaatatttgttgtcagacatgactgaacaattaacattgttatttataatcatcacactgtgcattagatctccaggacttacttatatactagttgcaaatttgtattattattattattttggccactctaggaggcctgtgagatcttcgttcccctaccagggattcaacctgggcttcctgcagtgaaagtgccaagtcgtaaccactggaaagtgaaaaaaataagtgaaagtgtcagtcattcagttgtgtctgactctgcgcccccaaggactgtagcccgcaaggctcctttggccatggaattctccaggcaagagtactagagcggagagtagtggtggtgttagtcgctcagtcgtgtccgactctttgcaaccccatgaactgtggcccgccaggctcctctgtccatgggattctccaggcaagaatactggagtggattgccattcccttctccagaggatcttcccgacccagggatcgaacttgggtctcctgcattgcaaacagattctttaccatctgagctacagggaagatccctaaagagggtagccattcccttctccagggaatcttcccaacccggggatggaacctgggtctcctgcatttcaggtggattctttgccatctgaaccagcagggaagccccctaaccaccggaccattggggaattcctacacatttgtatccttaaataatatctctcttatctcccccagcccctggtaactatctttaagtctttcccccaaactccaaaaataatatattctttgcactgaatttccaaggtcattctggaatgtgtttgggaatacagtctcagcatttgtgaaatgattctgcttgttcaaatcacagggttaagaagagttttgtgactttgcagtgtgttcccttttgaaaatctgttgtaatctgcctgtttaacaagacagtttgaatcattcagagagcatgtgggaacccattaaaatgcccaagcatgctgacttattttactgcccatatgaatggcacttatttgaatatttacatagtcaatatttaggtacttgtcttttcttatttaactttgtatttcgtattagagtagagctgatgaacagtgttgtgatagtttcaggtggacagcaaagggactcagtcattcacatacatgtacccattcacccccaaacccccctcctatccagactccacaaaacattgagcagagttccctgtactgtacaggaggtccttgtgggttgtccattttaaatatagcagtatgatacttgtcttttcaaattatgatcgaggtttaaatttccaggtactttaaaattgttttcaagaattgaaaacaactgcatggaaaagatatagaataaaaccctttacaaatggtcaaaactgaaagcacctgataaacacaaatgcagacactaaaacagcgccgtcagaagatagagcattcgtgttcgctgtccttgttttacattttgtacaagatttcttgaagtaatggaactttgctagaaattggtggtttgtgtctcctgctggagaaggcaatggcaccccactctagtactcttgcctggaaaatcccatggatggaagagcctggtaggctgcagtccatggggttgctaagtcagacacgaccgagcgacttcactttcacttttcgctttcaagcattggagaaggcaatggcaacccactccagtgttcttgcctggagaatcccagggacgggggagcctggtgggctgccgtctctggggtcacacagagttggacacgactgaagtgacttagcagcagcagcagtgtctcctgctagatttgtttctaaaatcggttttcctaaagggtttaatagggcttccctggtagctcagttggtaaagaatctgcctgcaatgcaggagaccttggttctattcctgggtcaggaagatccgctggagaagggataggctacccacttcagtattcttggtcttcccttgtggcttagctggtaaagaatctgcctgcaaggtgggagacctgggttcaatccctgggttgggaggataccctggagaagagaaaggctactcactctagtattctgtcctgtagaattccttggactatataggggtcgcaaagaatgggacacgactgagcgactgaactgaactgatatagtccatggggtcccaaagagttggacataactaagccactttcactttcaaagggtttaatgatttcccgcagtgctgagccgcaagccaaaacactttctttaggattgtttgctatttttttctttttaatctgttgccattgaagaagtcatgaagtaataatttatcatcgctcatatttggtgggttagagttcgcgtttgcaggagcatcaagttagcaccaaagagcatccctgaataaacgtgctatgagcttcacgcttctttggctggacagaggggaaatgtgggtgagcgtccctgttgaaaaagggtgtgataccaaccttgtgagtcgtatgtgtcactttccctaaaatttctactttgtttcaactaaatttttcctaggatagggaccaaaaaaaaaatgtattgtggaagaattcaaacatatttttacttttttcaagcatatttttaaaatgtaatgcccaaagaagagagaatggtttttatcaatcctaggtatccatcagccagctccagcaaggatccacactcctggcttgtgggctggtgctaattctagctttattttgtcactattgacttgctacttgggacatgctttcctattcaataaaaatggatatattagctattctgtgtgtatatcctgggactatattttgaaggccaatttatttatccaacaaattctgactaatcctactgtgagccaggactgggtttagtactggggacttggaggcagaacggctggctctgggaaatcagcctggatacgaagaccttgaaatgcttttctggcagaggtgtgtatggatcgtttttttgtctgggagatatttctttcacttgcttacactttagaaatgcaccttgatcccagttaaatgtcgcaagtggctcattaattaatcagggatatgcaacttacaacccatttgatcacaaacagaccagagatgcagcttgacgtgtgcagctcgaataaaaaggcttgcgctgtttctctccagcctcgtccccaaacggcacgtacatagcttctggtttggtagcagaaacacctaatatgagttcttttcttggaagaagggaaagaggaagagagggaacatggtgggaaggttaggaggaggaggaggaggaggaggagggcagataccagcaggggcctcagcgtgaccaagtccccaagggcctccctggtgggaggtgccagccagtgcctgggtttggagatgaagtgactgaattgctgtcaaatgcctgtctcacacacgcacacacatgcacacacacgcacacacacagagtctctctggagctctgagggtcccactttcatcacctgggtgcggtgggcctagcacagttggtgggggcacagccccgttaggaccgggctcccctactgccccctctgccgcatccctcccctcctgtctctgctgaagaagaccagatctgtcttggaagctgctgctccctgaccgggggagcgtggtcatgatctgttcctgttccctccttctcccaggcctgaggtctcaaagttggacccggggttggtgggctccctcccatgtgtggccatgtgtgctcagcacccccaccggggctgcagggaatatgcttggacccaggacctcagcgactgagctggttagtgaacgctggtgcacaggaagccccatctgctcccaggacaatgtgcccctccaatccccaaagccctctgtctcccagaccaggcggaactcccatcccctaccctgctctccctagagacggtccctccctaagtgccttgtcgggtgctaagcatgcgtgctaagtcgcttcagtcatgtccgacttttggcgaccctgtggaccatagggccctctgtccacgggattctccagtcaagaatattggaatgggttaccatttcctattccaggtgatcttcctgaccctaagattgaacccacgtctcttatgtctcctgcattggcagacaggttctttaccactaggaccacctgggaagtgccttgtcatggggccccaaatcagttgtcattgtctaggtaaatctggctctctacctgcctgcaggaggggttggaacaagtacagagcaggacaacagggagacgcgggagaggcagtgcccaccatgattgctggaccctcctgcactgcccacagaccctggcgccactgcccttctttgtcaagtgcaggcatagcccccttgaagatggtgcatggtgatactggcctcttagttgcattctcccaatgcagagcctgagacaagggtttgggtgtgggtgctttatttgggggacactccaggaagcaagggttgggaaacagagggaggaatcaccaagaagtccatgatggagattgctgctggaggcaacagagattttgccagtgagaaaatgccttcaagagtcccttcccggatgggtttagaacatgtgaagtctttccaggctcccccatcatcatcattcaagtgggcagcaaaataagtagagggcctgggggagccctaaattgccctgaaatgtgttctaacccagacagcagggctagattctctctcccacttcaagtgacttaaactcatccactatagcaaatactggtttgacaccttctcctggatttaaaggaatctaagacatcactctgcctgccaagcaggagacgtgggtttgatctctgggttgcgaagatcccctggagaaggaaatgggaacccactccagtattcttgcctggaaaatcccatggacagaggagcctgggagggctacagttcatggggttgcactagactcagacacgtctgagagactaactgtaacaaaagacatcgctggctgtaaggcatgctgttattctcagaagcactaaggagaatacttctggttatattgtaatacactatccagtgtaagacactttcctagttcagagatgagaaagtgtgaaaagaatgtgggtcttgggacagtcaactgtgtccaccacaccctagtggctgttgtgaagatgatgaatgtgcttttactccctagagaggagaaacgccacgcaccatgcagggagacggctgtgatagcaagatagaatagaatgacaaaaacaaaccaagtaagtgccttcacagtacagaggaagaagaggtgaattctggtggggaggaattggggaggccttcctggaagagggggtattatttgagatgggctcagaggatggcagggtttggattattggacatgaaggtgaaaggtgctccatgcagtggaaacaagatgggtaaagtctccgttgttgttgttcaatcactaagtcttgccagactcatggactgcaggccccccaggtccctctgtcctccactgtctcctggagtttgcttaaactcatgtccattgagttactgatgctatctcaccatctcatccactgctacccccttctccttttgtcttcagtctttcacagcatgaggatctcttccaaagaattggctgtttgcatagggtggctaaagtattggagcttcaacttcagcatcagtccttccaatgaatattcacagttgatttcctttaggattgactggtttgatctccttgctgtccaagtgattctcaaaagtcttctccaataccacaatttgaaaacatcaattattcggcactcagccttctttatggtccaactctcacatccatacatgactactggaaaaaccatatgcacctttgccagcaaagtgatattctctgctttttaatacactatctaggtttgtcatagcttttcttccaagaggcaagaatcttttaatttcatggctgcagtcaccatccacagtgattttggagcccaagaaaataaagtctgtcactgttttaattgtttccccatctatttgccatgaagtgatgggactgaataccatgatcttagttttttgaaagctgagtttcaagctagtttttttcattctcctctttcaccctcatcaagaggctcgttagttcctcttcactttctgtcatgtcattagatttgtaccatctgcatatctgaggttgttgatatttctcctggcaatcttgatttcagcttgtgatccatctagcccagcgtttctcatgatgtattctgcatataagttaaataaacagggtgacaatatacagtcttgacatactcctttcccagtttggaaccagtcagttgttccatgtccagttctaactgctgcttcttggcttacatacaggtttctcaggagacaggtaaggtggtctggtagtcctatttctttaagaattttccacagttttttgtgatccacacagttaaaggatttaccatagtcaatgaagcagaagtagatatttttctggaatttcctagctttttctatgatccagtgaatgctggcaatttgatctcttgttcctctgccttttctaaacgcaatttaaacatctgaaagttctcagttcacatactgctgaagcctagcttgaaggactttgagcattatcttgctggggtgtgaaatgattacaactgtatggtagtttgagcattcgttggcattgcccttctttgggattggaatgaaaactgaccttttccagtcgtatggccactgctgagttttccaaatttgctgacatattgagtgtagcactttaagagcatcatcttttaggattttaaatagctcagctggaattccatcacctccactagctttgttagtagtggacactgtgtgtctccagatttctttttacttttggctatgatctgcatgatatgcaagatcttagttccttgatcaggaactgaacctgtgccctccacaatgaaaagtgtggagtcccaaccacttttccaaatttcttttttcttcttgaggacacctggcattagatttagggcccaccttactccagtttggtgttgttactcccatcttaactccatggcatcagcaaggaccccatttccaaataaggtcacatttagagggccaaggttaggatttcaacatgtctttttttatttaagatgtatttatttatttttggctgtgctgggtcttcgttgccgtgtgatggctttctcttgctgcagcaagtatgggctactcctctttgtattgggtggcttctcgttgcagtgacttctcttctctgttgtagagcttgggcttcagggcacaagggcttcagtagttgaggtgatgggcttagttgccctgtggcatgtggggtcctcctggagcagagattgaacctgtgtccccacattggcaggcagacctccaaccactgggccaccagggaagccctcaacacatcttttttaggggatacaattcaaccccaagcaactgcaattcactggacaccttctatgtgttcaggatcatgttacgtgtgttgactgtagaatcatattcagtcacccccacaaccctgccagctaggttatattatcactccaatttcacacgcagggaccctgatgctcagagaggccccacagctagttaagaaagaagaccacactatggcgtacatcatatatcaccacctctgtgggcaatgtgagcagatggttcggacggggatacgggaaaagtgggcttccatggtggctcagtggtaaagaatcctccttccatgcaggagacacaggagactcaggagtgatccctgggtcaggaatatctgctgtaggaggaaatggcaacccacaccagtattcttgctgcaaatattccatagacagaggagcctggcgggactgcagttcagagggttgcaaagagtcagacacttctgagcactcactgcacagaaaaaaaggaaccctgggctttatcttcagcaagctgaagtcttgatggcggagtcaggcccaaactattccaagaaaatggaagaatgtgtataagacaaatagatatgcaattacaaaacatctcagaatcagagcttgagcaaggctgggctacttttattttctgaagctcctgacatattaagagactaaaacaagacatgctgaaagagacttctttgaagtaccagttacttaatttattttttaaaatcttcattgaatttgttacaatattgtttctgttatatatatatatatatatatatatatatatatatatgtatatatatattttttttttttggctgcgaagtctgtgggagcttatctccctgaccaggggtcaaactttctgaccctctgcactggaaggcaaaatcttaaccactggactgccagggaagtccctaaaggataagacattttaactgtttacactgagccactgaacactgtcaaaaatacaatgtcagcatattaagagataacacggaagcctgagcagtgaagctttctgagaatgtgagcctccggttttggatggaatgtggaccacagagcagagcagatgtgttggtcgagcagtgaggaaggggtgggcgcctctgggcaccacggtcctgggaggacgggccatctcccaccgcacagtggccagcagggaagggccgtacccatgagggtcaggaaggggacgggtgcacccggagcaggccgacagagcagttgctgaccccgtttcactagctttcagccgaagataacccagatgtcctgggagagccgttgaaagctcccagctttgggttttcatgtctctgccaggctgacaccagagagcagtctctggccaacaaatctttagagaaaaccctttcctgggggacctaaaacttgtagcttcagaattaatccagaaaaagatcccttttgtgaggggggaagggagcttctaacctcaacaccgctccttgtaacaggtatttgaggcttgttagtcacttggtcagtcgtgtccgattctttgtgactgcatggactgtagcccaccaggctcctctgtccgtgggatttcccaggccagaatactggagtgggttgccacttctttctccaggggatcttctccacccagggattgaatgtctcctgcattgcaggcagattctttaccgtctgaggcaccagggaagattgaatttgaggcttggattcaagaaaagcggtccctttcatcctgccttatggtcttcctaggacagtttctccacctgcaatcagaaatacctagctcccattagagcctgctcagtcagaatctaggtagagtacttcccttatggtccaatggttaagactccatactcccaatgcaaggggcccaggttcaatccctgactggggaagatcccacatgcttcatggtgtggggcaaaaaacaaaacaaaacaaaacaacacctcccaagccaaaaacaagcaagcaaagaatctgggtagaggcagggaggggcagaggtatttgcaggtgtctgttacacacactgaggcctgggacccatgacttcaagctctggggtggaggtaggctggggaagatggggtaagctgctggctcttgagaagcggggactagtgtaagtgactggacaggaggaggcctatgtgctgggtggggtggagggtgtgccatggtgctggcggctctttagggaagcgccccctgagcctcaggtatcagttatcagatcagatatctcagatgtcaccttgccacttttcctggttaccactggtgtgcagcccaccaccccaaaccctagtggtctatttattaaaaaaattttttttttaatttatttatctggtggcattgggtcctagctgcatcatatggagtcttccttgtggtacacaaaccttctagttgtagctcacacaggctcacttcctctgtggcacgtggaaccttagttccctgaccagggatcaaacccatgtgccctgcatggcaaggcagattcttaacctctgaaactactaccattttgggttaaacagcagtccttttattgtctctcatagcttctgtgggtcacaggttcaggaaaggctcagctgagtagttttgttgggggtctttcatttggcttccctggtagctcagttggtaaagaatctgcctgcagtataggagaccctggtttgattcctgggtcaggaagatctgctggagaagggatagactacccactccagtattcttggccttcccttgtggctcaactggtaaagaatctgcctgcaatgcaggagacctgggtttgattcctgggttgggacgatcccctggagaagggaaaggctacccactccagtaatctggcctggagaattccatggacggtagagtccatggggtcgcaaagagtcagacacgactgggcgactttcactttcacttggctgcagtcagatggtggtcagagagctggcttcccctctcttggttactctcacttgcttctccaggaggcctttctgtgtgggatcgtttgggcttctttacagcctggctgcctcatgggcccttttgaaagtgtaggggcttggagctctgcacaagcggtccagtgaacaaggtggaagctccatctccctttgtgactcggcctgaaaagtcacacagtatcacgtctgacacattcctttggttacaagtgagttacaggcctgtctagattcaaagagagtagacaccacttctcactggaaggactgtcagagtggtcatggactatagaggatcatgtgggacagtagatgttcttgtagccctcttggaacttatatatgtgtatgtgtatgttggtgtgctaagttgcttcagtcatacccgactctttgcaaccccatggactgtagcttgccaggttctgctgtccatgggattctcaaggcaagaatactggagtgggttgccattcccttccccagggatctttccagcccagggattgaacccgcatctcttatgtctcctgcattgtcagacctgttctttaccatcagcaccacctggaaagcctgtatgtataagtttatatataatataaatattggaacattttatattatatacaatatgtattccaatatatataatatatatttcaatacatatatatttgattctgggtgtgaaaatatatgttatattatgttacaccgtgaatcaaaacattgttttgaaaacagaaagttccctggctgatcagtctgttggtgaaagccccatgtccttgaactgttcttaaggagttggagcttttcattttgaaagtgaggagctgggagtctttgttcatctgaaaatatgtcaagtgcattttgagacctaaactgtaaataatgtttcttcaggtatcacttaaaattacttgcttgattatacttggatgggtgcttaagaaatacttcttcccatttcattgatgagtaaactgaggttcagagaacagacccaagtcacagcataataacagagctgggactaactagggttaagaattcctggtttccacatgaatacttaacactactgaactgtacaattaaaaatgattaagatggtcaatttcgtgttgtgtgtgtgtgtgtgtgtgtgtgtgtgtgtgtgtgtggttaccacagttaaaaagtaaattctggattccacattagaggctctgtcaagcgatccccctgggtgtgaagaagccattccagtttccaggagtcatgttgcagtgtccaggagctgatgatgcgatgtccaagactcagacaaaaccaagaacagtttgcttctttgctcggagctctacagcggttcccgacacacagaggatcaggtctaaatctctttgcaggatgttcagggctctccgggttctgacaagctccctcaaggtctgccttcgaaggcagagatcagatgctttgccgtcttcccacagcaacagtgtcaccaaggggatgaaatgatccagtttactgtgtgtgcattcctgttcagttgctaagtcgtgtccaactctttgcaaccccatggactgtagcccaccaggcttctctgtccatgggattctccaggcaagaatactggagtgggttgccattcccttctccaagggatcttcccaacccagggatcaaatccgtgtctcctgtgtcccctgcattgacaggtggtttcttatgtatatcattcctcaaaattaattcctacttgctggaggctgacaggcatttggtgaagataacagtttctggaaaagcttctccatcgtgctccccacccctgacacccaccctctttttcctgaagagctcttgtggtttttaaacaaaggagagcgacccaaatgcgaaaattcctttgttctatctgagacatgaagctgaaggagcatgagcgtgcagtctgcactggcagaggaatgatgggggcaacgggctgctgaggaggcgagaggaatctcggggaagtttccatatgccgaggagtttaacttgacgccaactgcgccttttcgagcagagcttgttccgcaccgatccgatgcgtctcaagaggcccgtaaaatttctcctacattttgtccacccgtggatactgcgacctgacgtgacccaagcagagatccgtcctggcagtgctttcagagaggactgagcattcgggctgcggcctaattgacagagttcggtttcgtcagggatgatggcttctggtgggagtggaggccggcggtgcggggagccgtgaactttgtcacagaacagtgacttctgtaagattcacagcagttccttccgattctgtcggaatgagctgcagtgactacagatatcttatgggctccaagtgacgatgcaaaccgagttttatttcgacctcaaactcctcgtggcaggggtacgggtggcggggggaccagaaatggacaaaatgtgaattctttacactgtttgaaatattttatctcatttattttagtaactcaaattaaataagtggaaagagatgaaaaaaatatggacgctgtttttttttttttttaatctattacagttcatctattcaaggaatgtgtcttcattgctgaaatccccatggttggttaagaagagcccaagaaaaaggctggttttactttgagatccctgaaagcatggaagctttacttcatgtttctaaacatgtgagggcagcaataaatccctctggattattatatgtttgattcaacaacccgatgcctttgagctatcatttttttgtttgtttttgagactgttctgatgttatctcgtcaatgcgtttgaacttcacacttcttatccttttctatcagaggagacccaggaatcagagccacttttcaaattcgtttctggcaatagtaacaccatcttagtgaattctgcctgattttagctaagtctacctgaccttgaaagaaatggaagcaaataaaaattataccattttgatgaaaatgtattagatgtaaaacctccaaatggggaattgcctggcagtccagtggttagggctctgtgctttcacggctgagggcctggggtcaatccctggttggggaagtgagatcccacaagctgcaaggcatggcaaaaagacctcaaaagaaaacagaacagacccctccaagtgtcagaagtgctttgcagacataagagtatttaaacaataaggactatgttattgtttatgcccactatgcccaccatcatgaccgccaccatcatcagaaccccatgagtcaaggctgttgagaattactgatcctgcaaagagcaaggccactaaagcacctctggccagctcagtggtggcttctagttgcccctgattttaccatctttgcagagcaacggttttagcaaatatggctctttaagactgttgcctgtcttcactaagttttcttcagtgctataggcaaaataaaggtggtgattgaataaaaactcacgaaaatcaaaatagccaccagaaattttgaatgcaaagatttaacaggtgacatttccccttatttcctttttttatttgattaatttatttattttaattggaggctaattactttataatattgtagtggtttttgccatacattgacatgaatcagccatgggtgtacatgtgttccccatcctgaacccccctcccacctccctccccattccatccctctaggtcatcccagtgcagcagccctgagcgccctgtctcatgcatcgaacctggactggcgatctatttcacatatggtaatatacatgtttcaaggctattctctcaaatcatcccaccctagccttctcccacagaacatcactcattatctgagaaactcattatccatcactcattatccaaatcaaaaccacagtgaggtaccatcacatgctgctcagaatggctgccaccagaaagtctacaaacaataaatgctggagagggtgtggagaaaagggaaccctcttacactgttggtgggaatgcaaactagtacagccactatggagaacagtgtggagattccttaaaaaactggaaatagaactgccataccacccagcaaccccactgctgggcatacacaccgaggcaaccagaattgaaagagacatgtgtaccccaatgttcatcacagcactgtttacaatagccagggcatggaagcaacctagatgtccatcagcagatgaatggataagaaagctgtggtatatatacacaatggagtattactcagccatgaaaaagaatgcatttgaatcagtactaatgaggtggataaaactggaccctataatacagagtgaagtcagaaagaaaaacaccaatacagaatattaaagcatatacatggaatttagaaagatggtaacgatgacccttattttgtttttaaaaataactttatttatttgtttactcagttttggatctgctgggactttgttgctgtttgggcttttatctagtcatggtgagtgggggcttctttctagttgcggtgctcaggcttctcactgtggtggcttctctggttgcagagcaggggctctaggcacgcaggcttcagtagctgcagttcactggctctagagcatggtctcagtagttgagacacacgggcttagttgctccaaggcatgtgggatcttctcagatcagaactgaacctgtctctcctgctctggtaggcagagtctttaccattgaatcaccagggaagttcccaccaccttgaaccatttctaaaagagctttaaaagatacacatgtgattttcaatttaagcaccatggatgtaactttcttgtgaaaatatttcactgattttactatgctgtttgagaaatttggagatgctctgggttttataaagccaaggctgggaatggccattccagatagatctgctgctctgtttgggcacttgtcactgaactttccccgattccagagagtgggaaacaagaagctagactcactgagttgtgattggctgtggtgagccagatggtgtgatttggatagggctgagctgtaatgcagcccagacatttaattttttccattattaaactttttattttgtattgaagtatagctgattaatggggcttcccaggaggtgctaatggtaaagaacctgcctgccatgcaggagacataaaagatgcgggttcaatccctggtttgggacgatcccccagaggaggcaatggcaacccactccagtattcttgcctggagaatcccatggacagaggagcctggtgggctacatccatggtgtcacacagagtcagacacaactgagtgactgagcacacacggatgcaggaggtcatgagactgatttctgttctgttggttaggatgtaaatagaagagtaatgccatagcttttaaggacattccttaagaggtggcctggttcgtttctaaagaagggacataatgctgctaagttgcttcagtcgtgtctgactctgtgcgaccccatagacagcagcccaccaggttcccccgtccctgggattctccaggcaagaacactggagtgggttgccatttccttctccaatgcatgaaagtgaaaagtgaaagtgaagtcgctcagttgtgtctgactgttcgtgaccccatggactgcagcccaccaggctcctccgtccatgggattttccaggcaagagtactggagtggggtgccactgccttctccgagggacataatagcagacaattaaaaattagtatttttcttttccctcatacatcgctgaccttttttggcactaacacatgtggagttagtgtcttttggggagtttggaataagatagaacagatgaaaatccttattttaccacttgttaactactttggggcaagttgctcagctgtttttgcctttgtttcctcatctgtagaagtaagaataatattccacaaattgtagggttaccatgagaattagagtgggatgcacactagagtgggttgccattcccttctccagggaatcttcccaacccagggatcgaacctgggtcttctgcattggctggcagattctttaccactgagccaccacaccctagagtgcaaagggggcttagcaccacaggaggttcacaaagatgtaagctgttcttattaaggctgaggtgggggttgggagaagggggagaaaaagttttgtaagttgttaatttataataaatccccaaagaaatggtctttcaagtacatacttatctaaaactttgtcaataggggaaatgttcttaggagagaaaaggaattttttcttttagcataaagctgactttctaatatgggcttccctagtagctcagctggtgaagaacccgcctgcaatgtgggaaacctgggtttgagccctgggttgggaagatcccctggagaaaagaatggctacccactccagtattctggcctggagaattccatggactgtataccatggggttgcaaagagttggacacgactgagtgactttcattttcactttctgactttctaatattcgaggaatgcttagaagtgtggccggtagaaaatagtcctttgtgcctgggacttcaagaaggcggcactatcttgatggaactcagtctcatcacctgtgaaatgaagagtacgtggtaccaactactttctgagctcacgcacagctggacgtctgcgcctttcttgttatactgcagatgaaaacattttatcagatgtttgcctaagtatggattacatttaagatacatatttttctttcttgtctgaaagtctttgtagtgagagcaggctggaattatgtctggggtgagatagttttcttggtaggctggtattcttgctctttagatcaaaactctcttttcatttttaagtctatcccaaaagtgtgggaggtgtccttgatgttgaattataggcagagggtcagtttatcaacacccaagaccaacatctctgcctttgataagagatagaaatagaagtggagagagaggaggaaaaacatgactcacgatacattctgggttgtttgtttttgtttttatttttgttttggaaggagcgggtgggggaacgtgctgattaaagaaagtctagagagaacaagattcttaaaaataaatccacagtgaagcccagcgggtggggatttcccacagattttcagggcttttttgtgttgtcatggggatattagtcaatgttggtgtcttattttggagtcactatgagtgaaccatgtttaaggagctatggctcagctgctaaactattttcaaaaggaaaatggtgtgttacggtttccgagcagtggggccctggtacaggtaatatcatactcaaaagcactcttttgtgctacatgaatgaatcctgctaaaccatgcggattaattttagctgaaattttttaggttaaagtgaagtttgtgaagtgacatctgagaaaaatatgttggaaatctagggagaactagagtcaatgggatttttaagaaactgactctttccattatctttctttttttccttccccacaactgtttttctttttttacactgagtctgtataagaaaacaggacttgccatgatatgaagtctactggtagattaaacagctcaagtttactcaatcatttactccatatctttttcattaaaaacactaggtaagtcttatttatcattctagtcagcagagcagctagaaatgcatccattcattcattcaaccaacaagtattcaaggagcaccttctctgtgccaggtccttgggcatggagtgatatcttgtggaagtctaattcaaggattgcatgtcacagggaccccctcagtaccattgcactcattttcttatgtaagtacctatgtatatgacatgtaagttaccagagacaactgatggtcataagggtccactttgagttaataaaaatatattcatggttctactgcatgtctaaagatctaaggattttacacttcctttcagtccagttcagttcagtcgctcagttgtgtccgactctttgtgaccccatgaaccgcagcatgccaggcctccgtgtccatcaccaactcccagagtctacccaaaaccatgtccattgagttggtgatgccacccaaccacctcatcctctgtcgtccccttctcctcctaccctcaatctttcccagcatcaggatcttttcaaatgagtcagctttttacatcaggtggccaaagtattggcgtttcagcttcaacatcagtccttccaatgaacacccaggactgatctcctttaggatggactggttggatctccttgcagtccaagggactctcaagagtcttctccaacaccacagttcaaaagcatcaattcttcggcgctcagccttctttatgggccaactctcacatccatacatgactacaggaaaaaccatagccttgacttagatggacctttgttgacaaagtaatgtctctgctttttaatatgctgtctaggtggccataactttccttccaaggagtaagcgtcttttaatttcatggctgtaatcaccatctgcagtgattttggagccctccaaaacaaagtcactgtttccactgtttctccatttatttgccatgaagtgatgggaccagatgccatgatcttagttttctgaatgttgagctttaagccaactttttcactctcttctttcactttcatcaagaggctctttagtttctcttcactttctgccataagggtggtgtcatctgcatatctgaggttattgatatttctcccagcgatcgtggtttcagcttgtgcttcatccagtccagcgtttctcatgatgtactctgcatataactgtaacctgtaatgtggctaaactctagtgcttggaacctacctctatgtgtaatatcatttattggcaaaaactcattctaaagttcagtgttagaaagaccaaggtccagtatggaggttagagggtgatggaaagggtctttgaggggaggggaaatgagaagaggaagtaagtcccaggcatttccaatagtaatactgttgggaagactttcaggtcctgtgatgagggtgtgtgtctttaggaaagacaaccattgacatgtgaaggaccgccatccatttgggcatctgagggcgctgtcagtgaaaacccagctgtctccctctctgacctgactggtggtattttgggggagccagggattatttccagtccatcctaaaggaaatcagccctgaatattcattggaaggactgatgttgaagctccaattccttggccacctgatgtgaagagccaactcattggaaaagaccctgatgctgggaaagattgaaggctggagaagggggtgacagaggatgggatggttggatggcatcactgactccatggacatgagtttgagcaaactctgggagacagtggaggacagaggagcctggcgtgctgcagtccatgggctcacaaagagttggacacgactgagcgactgaacaacagaagaatagggctggttcttctctgtgctccacgaagtggagagtcagtggctccagggctccagcctggctccccacagctgcggggtaggcagcataggaggcagtgactgtagccctcgaggctcttctgtccctgggctattccaggcaagaatcctggagtgggttgccatgtcctcctccaggggatcttcctgacccaaggatggaacttgggtctcctgccttgcaggcagattctttaccgaccaagccaccagggaagcccacttaaaatactaaacccgaaccattctgagagcctttgagaaatgacagctgactgattgcccacttcaaacatctctctcgttcgcccagattccaacttccaaccaactaggtcactttgactcaacaaggttaagtgtgggtttttcaagttggtccttcggcgtgatcgtctcacacaaccccggcgaaacttaaaggcagaagtcgatggcacaacagaacgggggtgctggctgtatcttcggactagcaggctgtctggcgtagagcaggaattgaagtctcctgattaggcttttcttctgctttattctacggaatcaaagtttcaaaagagaaacaccccttctggtcatttgagggggtgcgtggagagagccagggtggaggaaaggatatgctgaaagacaagatcacggagacagatgaagtccagtgatggctagcggccctgtctcgctgccgtcgggcagaaggccgggaggagggcgtataaacagaggcatctggtcccccagcatggagcggcaggtccgtgaaccgtgacagatgcagcctcagctgtgactgggcacgaggcgccggtgtccaagcccgggtcaggcgcagggcccattttcacagtgacagtgcagtgtcaacctgccattctctctttctcgggtgggttttgtggttttttttttttttcctctgaaatctgccagctctcggaagccgcatagactgggcccctcgggttcgcaggctggaggaggcgagcagggaaaagcagtgagtgacatctagagagggacgctggagggggagcgccagagcgccagcagcaagcccagaaagatgtgactgtggaggagggggtgcctggctttggcattgtcctgggcagaattcagtgtagaccgggcacttagcgagttacctaggagggcattttatcttaccgactggttttcactggaggatgattgctttgcatcatgttggtttctgccctacaacaacaggaatcaggcataattctgtttcccctcccccgagagcctccctccccgcccccaccctacctgctatgtcatcacagagctccaggttgggcttcctgtgctccatagcaacttcccactaactatttcacacttgacagtgtgcgtatgtcaatgctactttctcaactcatcctacctaggagggcgtgttcaggctttacttctgggatgtacatgtgggctctgggggagactagaagtgttctttacggacacttacaaaggaagccaggaatatcagattttctaagaatcacttgatctattcgagaaggaaactaaaagaacaggtgtatttgtgaggaactcacagtgttctggcaaaaaggcactttgttctcccaggtctccggggtgtttaattaatataactgccctcaccccaatgtgtgggggcaattggatggaacggactccattcggtgttggctgccaagaattctgaagtctctgctgggagcgacttgaaatacctggccttttcccgtcttggatccactcagttttcctctctttctctctttcttattatgaaggtgggacggatttccaggatttggctacgtgaaaaaaaacccacactgccagggcaggtttatactttctacttgtttctgaaagcctggagttggggctgaggagatgagactgcagtggggctcagacgaacctttgtatcagtgggctgagtctgggggtgaaaagccatgtgtctcactaacctttccttccatagtcaagctctggtgtttggattttcttgtctcctttctctctcttttagtgctgtgcccctcttggggttcacttcttacttcctttccatccctcatccatcatggagggactaataagtcagaaacgactcagaaatctctaggcaaagaatacttcccacttgtgggtggagagacctgacaaataccctagtgatggggcatcctaggcacctcaggcccccaaagcccagctaagtgccttggggttgcgcttacagttagaaaataaacaagcaagcaaacacaaatcctaatcattttacttgccatagtctgatttctgttaaacccagactgattccttacggaggtggattcctaagctcctgaatcctgtaatttcccatgatgatggaaccttccttatttcttttcttcctcactttctccctagagagatgtagtcctcacatcatatgtcttagaatttgcttccatctctcatgtaccctgtgttcttgttgctgctcaggtgctcagtcgtgtctgactcactagtgatatacctatggtcttatggttgtcgttcggtcgctcattcatgcttgactctgcgatcccgtggaccacagcacaccaggcttccctgtccttcattatctcctggagccttgctcaaactcatgtccagtgagccggtgataccatccgaccatctcatcctctgtcgcccccatctcctctacctacagcgaagtctgtccggactctgcagctggatgctgcttcccgtctctctcccatttgcacacctgtgtgcttgaccttctccctttgtgtcgtatgactcctccccacctcccttctctatccctaaggggctaatcgcgttttggtactcacctctgcatttttttcctactcaaaaccctttggagactgggcgtgggatggcactgtgacaccctaaacatttcttggtctctgaatagaagctgaccaaacgcacgggctcagtgctggatgggcggcgctgcttctaaatgacacgctagccgagcatctcagccctcttgtccactcttggtccacacgatgcctcttattcgcccaacatgaagtcttccccagaagaccatcgccacactgatcacaccggagagtgcgctgaacagcaagtttccccagcgctgtgggtgcaaggtgcctttcctctgcaaacatctggccccttgataaatcgttgccgtgctccaggcccagtgcggaggctgcgcgcgctgctcgaggtctgttctcaagttgttgccgggaccccgccgtatgatgacaattaggagctgttagtgtgcagatgaggcctgcgagtggcaggtggccgggaacgggcctcaattaactaacaggccccaaatcccttcctaatgaggctgggccacccagatgagccagaaggcatgtgtcagtgacagcaacagaggatttgcaatggagagggggagaggccggtcaacaggtaccttggctggtccgcagaaacagccgttctggaagggtgtcgtggctcagaaagacccctgagccagccgggccgtggagtggcctggagcgggtagcacgggtgggacttggtttcactcctttgatctttccaagtggccccctcctgggtcagttcgtctccttggtgtgtacgagtgaagcatgaggctgtccctcaggataagtggtacatgggacatggcaggccagcaggcaaggtaatgatgtcagacacgtaataaaggacgattgtcttgagtggaatttgaattccaaatcagactccgcaataaccgtggcaagtgtcacgttgggctctgtagttaagggccggttgccatttccattgcaaatcttcgggggctttgtgtggattcctcatctgagcagatacgggatggagatctgtctggctccctgtgagagcgcttatgaattagaaaggagagcaaaatgttaagaacgcaccgtgttagcaagggaggtatccctggtagaattctgggctccttgctttgcttcaatccctcacctgaaacggcttgctgggaagatttgagactggcccatggagtgtgaatctccccagggtttgaagaacttgaaataaatcagttctctcacgcttctgctgctgtgggtaggagggcaccgattatacatgtgttttccctggaccgcagcttgtgccccagggagtctccagaggggcctttgtgtgtgcacggttccctaatcataaacccatattccagcatgcggtttagagctgtgcttaaagctgattatttattatccctcccttctttcttctcttgtagcatcaaaatggtgttgaagacagcctgatgccttaaatgttaagacaggggaccgctgctggggctgtggctgcccctttgtccacatgtgtgatggtgtttggataacattatgaaccacatgtgccaggctgcggagctcagagacaaaggggcaaacagagacccctgggggccaccccaccctcctctcttgaggtcatttctgacccagagagtgcgtaactgagcacctctgtcctttctctaacgttgttgacgtaacaacgtatgtctagaaagaggagtctcctcctttcgaaaggaggactttgccaagttttactcatccagctagttttatctttacctgtttgtagctctgtgtcttggactattgaattctgtggcacacatttgtctatttgtttaatgacctatgtatctgctcttgttcttgcgggcttttctctggttgggggcaggcagggccggctttcagtcgtggtacccaggcttctcttgctgcggagcaccggctctagggttctctggccagcagtgaaacacgggtcctagggcacaggctggatagttgtggctcacaggcttagtcgctctgcggcatgtggggtcttcctggaccagggactgagcctgtgtcccccacattggcaggtgggttcttgatcactgagccaccagggaagcccctataaatttatttattgtcctgagtatcccctagtctccaggtccttttaggacagtccagaaacaccggtgacggtagagctgtaagattagaagatggtacacatcttatttccttccttcctcccctcctcccttccttcctggatgcctctctctcatcctttcttttttgagcaagacccagatccaaaaccactttaggtaaaacatgtctttgctcctccagaagctccacagggaattaaactccctgtttccaattaagtcgtatgaaccctgctcaggctctagtccagcctagagttcctgggcagggcaggggtcctttctcggttcaggtttgagtggccgagtgatgagttcgaagctgcgatcgaatcagcacaaattttattcagtggccaaagaatagagaagcagatccctttttcacctgtctggtgaggggcatttaatttaatttattgttattttaaaactttttattttgtactggggtacagctgattaacagcgttgtgacagtttcagatgaacagcgacaggacccagccatccatacacattttacagatgatgctctgagaactgggcttcccaggtggctcagcaggtaaagaaatccgtctctagtgccggagacatgagtttgattcctgggtcaggaagatctcttggaggtgggcatggcaacccactccagtatttttgcctggagaactctgcgaacaagaggagcccggtgggctacagtccatagggtcacgaagagttggacacgactgagcctccaaccccttacatccttatgtctgtacctccaggctccttaacgattgagcccagggggatttccagccaaatgcctggtcagcccttagctttgccttcttctctccaccctaggttctttgttaactctcttctcttgccctctgaaccctgacttgattagtctaaaactcagcatctaagaccctccaagataaaagttcccttcagccagtggtgtgcggtataaagagttaacatctagttctctgcagtggggtggagaaagccctgatttttagcatttactaatttctgtggtataaatactcccgagaggatcacaaaacagagttgtgaagagacacaattggagccagtgcaggccaactgcacaaaccaccactcccgtccccagagagctagaatacccatctaactgggagatctcccagctccgaacacccacaggaccaaagcccctgccagccggatctgcttgcctgcgtcctcaccatccccagtccctcagcaccgctcccctcccaactcttctagatcaaggcttggtcctttcacagtgtccaccaaggacagctgccccttggggtggggagagaaggcgggtattccacctccctcccgccacgtgtgactgatgggtctgcgtgtcaggtttgcctcgttcagcccatgaggtgtctgcagaggtgctagcattcatgcttagtcgctcagtcatgtccaactctttgcgaccccatggactgtagcccaccaggttcctccatccatgggattctccaggcaagaatactggagtgggttgccatgccttcctccaagggatcttcccaaccagggatcgaacccaggtcttccgtattgtgggcagattctttaccatctgagccaccaaggaagcccgcagaggtgctggacctccctcccaatctttctgcaagaaatatctttttcactaggacaacactgggatggggtaggatgtgatgctgatgctgctcatgctttgcacttaactgggttcacagccaggcctgtgcccaggacacctccttcaggaagccttccgagatcttcctcagtgtagatttcactggtgtttctgttacagacctgcactcttttccatcagaaccctttgctcatcctttaatgtgattatttgtctctatacatcaactcaatggacaagagtgtgagcacactttgggagacagtgaaggacaaggaagcctgatgtgctgcagtttatggagtcaccaagacagtaaatgaatagcaacatccatcactaagttctgtgagggcagagtgtgtgtccatttgggcaactgcctcacccatgatgttgatggatatttgtgtgatgtgtgaaaaaaaagtctgcaacatgaatgaaagacttgggccaccactgttctccccatcgcaggctgcccacttggctccctcaggcttaagcaaccccagaatttcagaggtttcccatctgtttcatttccagcagctagaaaagatatggtatatgaaacactttctgataacgcttctcaagttatgccctcaggagactgaaattcattcatccattcatcagtcaatcaacaaacattaattgagtacctactaagtgccagatggtctgacagctacgaggagtaaagaggagccttaaaactcattgatgccttcagagtacttctgtgctggtagaaaacacgtcccttccttcaggattgactctcccactgagcctggtgtgaagagcacgtgtgttagtgacagagaattcacctcgttgctggcttctgacacttattagttgggttaacgtgaatgggtcaccttatctctctgaacccagctttctcttctgtgatgccagggatctagaacttaccaggctttttgcaagcagcaaaagcactacgtgtgcactttttactttaaatcgccaatgagatttttctcctaaagttttaagaaagactaataactgagtcaatccttttaaaggctctgccccctgagtttttgccaaagaggttcatcaccgaggtcttctttctctctactcctcttcaaccccctcgtttgggtgcctgacagattcctaggaagaccacgctcaccacgatatttaaatatctgcgagggacttgtaaaattcttgaccccaaaaacagacattgtgcttaattgctgggctctcccatggttttgacagctacagtacctggtttcacgttgctgctagccagaagtcacccgttgaaacatgttttcttaaacagtgactgataagttgttatcttccagcttctcctgctaattagacatcatgagtcaaagttaatttggtggaaaacatttctcaatttaatgacatttatgggcaattaggcacgtgtggaaggggacgcagattcacatttcagcctatttccagggcttaacaagaatctcctctttcccggttggagatttctcattctctaaggagtaagttccacacagacaccacgggcctccttgttatgctagaaacaagctaccacacagtaatgaggtgcagacggagataaaatcaggctctgcggacgttcctgtgttgcgcagacccaggccgcgtggcaagaagtcccgagtgaagtgcaaaccttggtcacggactcatgttgctgataaatgcatgccaagcacatgttttcagccccttgtcagaaatggcttccgtttttcaggctaactcatttgagaaacgagctagccatggaaaaattagcacccttaaattttcaagggccttaaatttcaaattttacgggcctttggtcttaagatgatgttactgtgatttgggggaagcaaaacattctcaaagggtcattttgtcgcagtgaactgctacattctccttgcctgagcagtagctgagaagcaaaggcgtggattcttgggcactggggtcctggctcagctcctggacagtgttgtacccacctgcctccgtctaagccagcatccttctcgcctgactcgcttctctctgagagatgctttaaagtcacatgaagttgctagttcttttcctttggaagggaggaatcatcttggtgtgtatgtacacacacacacagataataaatggtggtgactcctccctcttcccgctggtaggctggtttatggatataataacgaaactaaagtagtccaataactccaaagcgattcagtgggctacagggctgagctgggattacgattgaccaaaaccttaacctaacagctgagggcctttcctacgatgccatgaattcgcagttctggaaaactagaatatgagatacgcctggtgcctcaagattcacgaagttctcatattctacagaagtatttaaaacaaataattttgtttgatgtatgacacatgtacttatcatatatccaaatattaaaaaaaatgttctgggtggttgaggggtaaaataaaactttacataacaactaataataactttgattgctcattattctatgttttaggagttaggaactgatgcttcctaaggaggagggggttgggagagggatggagtagggggttggggttggcagatgtaggcttttatatgtggaatggataaataaggtcctactgtacagcacagagaactatgttcaatatcccatgataaaccaaaatggaaaagactattaaaaaaagaatgtatatatatttatgtatatatatgtataactgaatcactttgctgtacagcagcagttaacacagcattctacatcaactatacttcaattaaaaacaaaagaaatcttctaaaatataataatatttaatatatgaatattattatagtatgatacataagcacctatgtaagggttgtaaataatatatacatattaaaataagaggaatgtacaaaacaaaataatgatcaggtgaaagctaaagtcagcaaaataaatagcactttctttcaataaaactttccaggagacaaatgcagttttctgatggtctgtactgcagttcactgagacccaaatgtctccaaaactaatgccctgctgagacctgctccatctcgaggggacagtccacccgcaagccctggggcaagtgttggtgggcagctgcagcctggaaattgtgaaatgaagggagagggggctggcccccacgtgcccattggagaaactgcataggactgctagaaaattcctcccaccttcagtctttcccagcatgggggtcttttctaatgagtcagttcttcgcagaaggtggccaaagtattggagtttcagcttcagcatcagtccttccaatgaataactcctgtctgtaaaatggagctaaccatacctgccttgcaaagttattggaagcatcaacaagacggcatgtactgtaagctgcgatgcgctgactgtggatggcgctggagcagctggtttggagagaagcttgggcttttcctctggatctgggagctgaccgtggtctccatctggtcatcgcctctggaccacatgccgctctcctggcctttcctcctccgctcccccatcacaatatgcctgacgggcgtccttctctgcaggatcctgctttctgccaggtgacagccagataatccagccacacactccttactaatggggattagggtgctaatgggttctccctctaggttaacatatgtccttctacagaggggcctgctggagacgatgctttggccagggaaatgactctagtggactggctttgcaggcagtgggagggactcttgcagtgggatcagtctgcaacccctgatttacctctgcaacaaaagtctggccaaacccttcagcatccgcatccctctattcaatttcccaacatgtaaaactcagaagacttttcttgaaggagaacaaaatatatctcctaatggatctattgatttatccaagatttcctaagcatcttgtaaaaccatcatgacagttatcatttgttaagcacctgtgctgtgtgcttagccactcagtcgtgtccgactctttgccaccccgtggactgtagcccgccaggctcctctgttcatggggattctccaggcaagaatactggagtgaattgccatgccctcctccaggggatcttcccaacccagggatcgaacccaggcttcccactttgcaggcggattctttaccacctgagcacctataatgtaccaaaaactcatacttggtgtttgctgtataattatttcatttaattttaacaaccacctcctccctaccctactggtaaagagacaaggtttttgttttctaacaaattgtggtaaaatacataatataccatttaccatcttgacactttttttttttttttttactattttttggccacactatgcagcttataggactttacttccctgatcagggatggaatccatgcccactgcacagaagctccatgtcttaagcactggaccaccagggaagtcccttaaccatttttaatggtatagtttatgggcactaagtacatccacattctttgcagccatcaccaccatccatccacggaacacttttttttttttttttttgtaaaagaaactctacacctgttaaacaagaatgccccattctcttctccctccagccccgacaaccatcatgccacttgctgtctctatgaatctgactctactaaggtaccctggattggtggaatcacactgtgttggtccttctgtgtctgcttatttcacttagcaaaggtctgtatagtcaaagctatggtttttccagtagttatgtggagaggtgagatgcttcagttcctctgatgcatcagttcttctcactccagatgtgagaggtggaccataaagaaagctgagcaccaaagaattgatgcttttgaactgtggtgttgaagaagactcttgaacgtcccttggactgcaaggagatccaaccaatccattctaaaggaaatcagcctgggatattcattggaaggactgatagtgaagctgatggcgaacagctgactcactgaaaaagaccctaatgctgggaaagagtgaaggcagggagagaaagggacgacagaggacaagatggttggatggcatcacagactcaaaggacatgagtttgagaaagctctgggaggtggtgaaggaccagcaagactggcatgctgcagtccagggggtcacaaagagtcagacatgactgagtgactccacagcaataatttcctcaaggttcagatgttgtagcctgtgtccttttcctggctgaataatattccactgtgtggacagaccacattttatttatccattcatctgttgatggacctttgggttatttctaccttttggctattgtgaatgatgctattacatgtaacatggtgtacaaatatatctttgaaaccctgttttcagtatatacccagaggtataattccaggatcatatgttaattccatttttagttttttgagaagccactgactgtttttccttttgcaccagcagtgcacaaggattccaatttctgcacatccttgccaacacttgttatttttcaaaaaaaaaaaatctatctatctcttttggctgagtcaggtcttatgttgctctgcaagggctcttccttgcagcaccaagacttctctctagttgctctggagtgcatgggctctctacttgaggcacaagctctgtagttgtggtgtgcgaggacccagttgccccaaggcaggtgggatcttagttccctgaccagggatctcacccatgtcccctgcattggaaagcagattcttaaccattggaccaccaaggaagtccttgtcttttggataatattaatagcccttctaatgaatgtggaggagaatggacttcaggacttcagtttatcaaaataaactccctccacctctctgtgtccctgtgtgccaacccccttacccaaaataacccaggccagcttcccacccccctgcccctgccaccagctgctgctctgccaggctccattgctctcctgtgatccgctgacccactgcttttggctcatacgcctttaatcgggagggtttctttggagaacttcagcaaggtgccagcccctctttggtttttaatgactgccctctgacttccctggtggctcagctggtaaagaatccgcttggaatgcgggagacctgggttgggaagatccccctggagaagggaacggctacccactccaggattctggcctggggaattccatggactgtatagtccacggggtggcaaagagctggacacagactgagcaactttcactttctctgacttcaaccacttaggattaaaattcaccctgcttgcaggcaccagattctcccaccaggatgtttgatgttgaaggcttctggactcctggatctgctacaatcacacacagtgtgtggttattggtctctggggagaagcagctcccctgatgataaaactcccacagataaacttgactttcctgtgaccagggttcgagacagagggatgggtagtcaggagtcttgaactgggatttcaagaactgctattcttcctgtgctccaaattctatatgcagagttgaaacaaatacgtcaatttccaggttgacaatatagaggagcctggtgggatacagtccatggggtcgcaaagagtcggacatgactgagtgcatacacacacacacacacacacacacacacacacaaccatgtgactttacaatccactggccagtaaggggcgctgttgattgagagactgtggctggaagctgggcaaaagaagtgaccagcggatatttgccttctcaagtcctttgaggcttccctgtttgggggcgggggcgatcttcctggagctgaaaaactcaaataagtggcttcagagagaccaatccccagggctggtttctttgccaagtcctccctagccaggccctctcctggtcctgacacctgtagatccctgtcagcctggagggctccagaccactgcggacaagctccgggctgtgactgctccaggctgaaaactgcagcctacttgttctttttactgtttctattgtcgttttgtttatttatcttggagaactatggcaggcaaatcccatccccccctcttttttttttgcactcagagcactagtcccataggctgaaatctacccagcactcagccagacagactactggaattgcccagtgaagttttcaaacggggagagagttaaagccaagaagagaaagaaaaggacccaaagatattggcatcacatatccatcctgcttgtgatggcgtctattcttgtgattggaaaatatatattatgttgtgttaattgctcagtcatgtccgactttgtccatgtaattccccagtcaaggatattgcagtgggttgacatttccttctccaggggatcttcccaacccagggatggaacttgggtctccaggattgcagacagatccattaccctctgagccactagggaagcccaaaatataccttttaaaaactcccctgacctcatctagtccaggtttgaaagagagtgtgctgggtttctgacctaaggcaagaggctcatccccctagccagctccttccagaggccctgaggcctgtgttcactgggaaagcacttagagacgccctccagaaaggcctatagaagtgcaaattattaatagtcattatgctagtgatgctcacttaaaaccccgttggcagcggataaaacagaggaggcctctcgccatttgcttgggcttctcagcacaggacagcaccaaacatcagatgtttgaaaactcaggatactggcacggtttttgtttgttttgttttgtttttatcagtcaagtgaggacagccaggttttgagagaaaggtgagttttctcttgagctggcagcgaactggttaaatgcataccatccccctttctgggtctgaggttatagttgaagataaatgtgctcctattaacatgcagattgggatatccatttgcaaagaacggagttatttcagatgctgtatgggaatcctttctgtatttgtgtctttgggggtagaaagtccagctgcctcttctaagattgcccataactcttcagatgtcaacacatcattgaaaggtgtcagaatgggggaaatgaaagataattattccagccgtggagagctactttgaaagtgaatagaatctgtcagatcgtcttttgaaaacagcagttggctgcttgtcctggccatattaaatggatatatctagagcccagtgaggctgtttgagatggcggtaatcagcttaagttggttttggtggaagggaaaaaaggcactagaaacagggcaattactgagttggcgtggaacagccgccctgatatggtgacgagggggcttctattcaggtcttaaaaaacggattcttacattctttgtggatgaataaagggcaaagtccgtgaggacttagtaatttccagatggggtgggtgtggggcagcaaggagactccaaggggatcccagtggcctgcggtgtgcagctcagtctcctcccaggaactgaaccaggaacgggaggacagagcgacctcgaggccaggtaaggtgggtgccacgtacttacaccggaaatgaaaatggaggctcctcagacttgggttatgactggagatgccaaagcatccagcaagtggctttcgacaaatgttcatatggtatagacatccggcttattcctgcttcccgcatcccaaaaccagacctggggaacttgaacatacctgctaacagaggaaacacctgacccaatagagagagggcctggagaggtgtctcctgggcccacttcttccagatttaaagcttagacttcgggcgctctctgaacaaggctgcttgtagatctggccccagaaagccagcctgctgcacaagtcaactgactctcggccccagcaccggcccacgctgaagcacacggtgaaagactgcttttacgcaaaccctgccattattccgtggagagtggagctgttcatgtgttgtgcttctagctggaaagtgaatctatagtgtggagacaacttatccctgtttcagcgttcttcatttgctaacatcgtgggagcccccgctggtatcaggggtgtgcgggtctttggaaactgggcgcagcaggctcttgtggtcacaggaccaaggctgggtggctttgcggtctgtggcacagatctctgccgttcccaaccacagacacttatctgccgccaaagcaaggaggcagtgttccaccctacctggggcaagtcagggacggagaagccccctacctataaacagtgcaccctggcccactgggggtgcaaaggtctgtcgtgtatgggtgtccccttccagccccccccccctgccctccacccagcccccgtcacctgacagttttatatgtagaaggcctgtcccaaacaggcagcccttaaagacgggagcccctgcaggctcctaggaagaaaagggtattctgtctctctgctgtgtttctgcagaaaatcacgccatcccagttacagttttggccagggactcaatcttttgcagtgactggtgatcactgttgcacacagaggcattttccagaactcctgacgcccagaaagaggtctgggcttctctggtggctcagacagtaaagaatccgcccataatgcaggagacccaagatcaatccctgggtcaggaagattccctggagaagggaatggctaaccactccagtattttttgcctggagaattccatggacagaggagcctggcaggctacagtccttaactaaggggcgtgggacatacaacagtcttctgattcaacacatgtggattcagaatgaattcttatgcacatgtttttaagcccccggccagccctgacaccctggcttgatttcattgttttgggattcatttatttacccactctgcaggtgtttcccttgggggcccaggcttcagaaggagttccaaaaaggattccgctgggaggagggatggactgggagtttgattttagtagatgcaaactattccacatagaatggataagcaacaaggtcctactcgagaacacagggaactgtggcttgagatgggctgagaaaaaccataaaggaaaagaatataaaaaataatgtacataaatatatatgtatatatatgtgtgtgtgtgtgtgtgtgtgtgtgtgtaatgtctgagtcactttgcggcaccacagaaactaacacaatgttgtaaaccaactatactttaataaaaagaaaaatagcaaaaaggactctgagtgctagtgagcagtcttggaaaggtgagaggaggatgctctgacaatttctgcatctcagctcagctcttcacattgctttagggtgagtgaaccgtttggcattggctccaactaggctctgggctttgttccaatctccagagacccaggttctatctggcccagcccttgccagcagttagctgtctgtccaagggcaagtcgtttgccttgaatggcttcagggttcttctgagtaagaaaatctcttttccttttaccacatttcagaaatgcaggcctatcgacatggctttgggcttcccagggagcgctagtggtaaagaacctgcctgctgatggaggacactttagagacacgggatccatccctgggtcgggaagagggcatggcaacccactccagtattcttgcctgaagaatcccatggacagaggagcccagcaggctacagtccatggggtcgtgaagagccagacacgactgagtgacagcacgcacacacgcatacgccagtgcccttgtttacatggcaaggtgggcccattctgctcactctttggcaaactgccacccagtgatgagtttcacggccataaaaatgtggctgaatgcaagaatgtgggcgcagactcccactgaggtcaccacacgtgagatgtctgagtgtttcgactctgttttgttgtccgtggaagaggacaatgtctgaagtatcttgaccacctatagcttgggtcaccaccttggctcagaggtcagagaggagcaggaaatggggcactaggaaatggggcacaagaggggagcccacagcctggataggaggcaggacagggttcccagggcactaagacatacgacacccccctcccctgcacagtcatgactaggcatccttcaacaagggccagttcctgtgggacactttactctgcgtgacagtctcagctaattggttactgtttcactggtgaatcgttatacctgttctccatttttcctatttattaaaaaaaattcagttttttttttttgtttcacttgattttgatccaaagacttccaaaatggaaaacagagggagggaaaaagtgagatctagttcatttaggaaatatttagtgggaatttctctcttgggccagtggctaagactccacactccccagtacagggggcctggattggatctctggtcagggaactagattccacacgccacgactaagagtttgcaggtcgcaactaaagatcttagtgtgctgcaaaactaagacccagtacagccaaataaataaacaaataaatactttttaaaaaacttgagaaaaaaagaaatattttttggactatgccacaaaatgttcaagaatatgtaaggaagagtctgaaaacttggattctaattccatatcattttcttgctctgtgaccttaggctaatccctcggtctctctgagctacattggcttctatagaatacaaataataatatatgccttactaaggcaatggcaccccactccagtactcttgcctggaaaatcccatggacagaggagcctggtaggctgcagtccatggggtcgctaggagttggacacgactgagcgacttcactttcacttttcactttcatgcattggagaaggcaatggcaacccacttcagtgttattgcctggagaatcccagggacgggggagcctggtggactgctgtctatggggtcacacagagtcggacacaactgaagcgacttagcagcaaacaaataaacatatatgaaaacagcttgtaaggtaaacagatgtacctaaagcattgatatacataaagctgagcactgaagaattgatgcttttgaactgtggtgttggagaagactcttgagagtcccttggactgcaaggagatccaaccagtgaaccctaaaggtttcagtcctgaatattcattggaaggactgatgctgaagctgaaactccaatactttggccacctgatgcaaagaactgactcattggaaaagaccctgatgctgggaaaggcaggagaagacagggaggacagaggatgagatggttagatcaagtcatggactcaacagacatgagtttgagcaagctctgggagatggtgatggacagggaggcctggcatgttgtagtgcatggggttgcaaatagtcagattatgagactgagcaactgaactgactgatagtagtaaaaaccagacaatctcataaaaatgacttgggtcatctttgttataaaagtgagtgaagttgctcagtcgcgtccgactatttgcgaccccatggactgtagcctaccatgctcctccatccatgggattttccaggcaagaatactggagtgggttgtcatttccttctccagaggatcttcccaacccagggatagaacccgggtctcccgcattgtaggcagacggtttaccgtctgagccaccagggaagtcgtgataagttccatctgataagaaattagttatgggaaaaaagtctagatcacagaaaaacacaattgcattttagtcacacaaaagacagtgaaggtttctacccgcctcctgggcccactgcatctactaatataagaatagcagccagtcagttcagggctgctagatgttgtgctgaccaatgagaagggagcagagtctcttgcctagcttttattggttactggagatgtcaatcactggctgtccactcgtaacccactaataggcttaaaggtccattgtctacaccacctgacctgatcggggcccatagtgtctgactagtttttccagcttttgaaacatgagtggtaccctttaattgctctcgtggggattgtaattggaagagtgaattcgtcaagtgaaatcaggtgaagcagcacaaaaggcaggtggaatttgaggttcagagactctggcccgcggaggtcgtgtgtaagttggagggatgaaggcaagagaatggagtgggtttccagaaagatgtagaaacaccgtgaggggaaggaagggtggctccctgcggcccgcagcctcctgtgtccgtgtctcagtgtctccaggccctgagtccccttttccaggtgacctgagtttctattccaagagggtagctgtgcgagtcatcttaggattcaaacctggaagactggggaggagggagcagctgccagagtgtctgatcaccaagaccagctccagctttgccacaaacagctcctgaattggaaatcctgtgtcctttgcaggagaaaccatcccctgggtcacggtcacctgggagcctggttgtaggcaggggaggcgttttttttccttcctttttctgcagatcgaatgacatctgggttaaagaactgcctgtttccgtctggatatttacaagtgagcctgcctttgtttcaggtccagaccctcctatcccaatctgctgccttgaaaacgcagattagggatgcagatcagcctggggctggttaagcacgaattcctttgttggtggagtgactcaaaacccacgtatctaacggtgggtcaggacatcctcagaatcatagactatatcacattgtccctgtgtgtgaaggggagtggatgacacataaccaaaatagttataatgataataaaagtgaaagaaaaatgaaagcgatagtcattcagttgtgtctgactctttatgatcctgtggactgtagcacaccaggctcctctgtccatgggattctccaggcaagaatactggagtgcattgccatttccttctccagaggatcttcccaacctaggtatcgaacccgggtctcctacattgaaggcagattctttactgctgagccaccagaaaagccacctcagtcagttcagttgctcagtcgtgtccaactctttgtgaccccatgggctgcagcatgccaggcttcactgtccatcaccaactcctggagcttactcacactcatgtccatggagtcggtgatgccatccaaccatctcatcctctgtcgtccctttctcctcctgccctcaatctttcctatcatcagggtcttttccaatgagtcagttcttcgcatcaggtggccagagtattggagtttcagcttcaacataagtcctttcaatggacacccaggactgatctcctttaggatgactggttggatctcctttcagtccaagggactctcaagagtcttctctaacaccacagttcaaaagcatcacttcttctgcactgagctttccttatagtccaattctcacatccatacataactactggaaaaaccatagctttgactagaaggacctttgttggcaaagtaatgtctctgctttttaatatgctgtctaggttggtcataacttttcttccaaggagcaagcttcttttaatttcatggctgcagtcaccatctgcagtgattttggagccccccaaaattaaactgtttccattgttttcccatatatttgctatgaagtgatgggaccagatgccatgatcttagtgttctgaatgttgagttttaagccaactttttcgactctcctcttttactttcatcaagaggctctttagttcttcttcactttctgccataagggtggtgtcatctgttgatatcatctattgatatttctcccagcaatcttgattccagcttgtgcttcatccagtccagcgtttctcatgatgtaatctgcatataagttaaataagcagggggcaatatacagccttgacgtatttctttcccaatttggaaccagtctgttgttccatgtccagttctaacttgcttcttgacctgcatacagatttctcaggagacaggtaaggtggtttggtattcccatctcttgaagaattttccacactttattgtgatccacactgtcaaaggctttggcatagtcaataaagcagaagtagatgtttttctggaactctcttgcttttttgatgattcaacggatgttggcaatttgatctctggttcctctgcctcttctaaattcagcttgaacatctggaattttatggttcaggtactgtttaatcctggcttggagaattttgagcattactatgctagtgtgtgagatgagtgcaattgtgtggtagtttgagcattctttggcattgcctttctttgggattggaatgaaaactgaccttttccggtcctttggccactgctgtgtttttcaaatttgctggcatattgagtgcagcactttcacagcatcagctttagacgccacctagtacttgatagataactaggttttgcatgaagtgctttacattaatgttgtgggatagataataaaattattcccattttacggagagggaaattgaggcccagggatactgggtaagtagcttaccaaatggagaaggcaatggcaacccactccagtactcttgcctggaaaatcccatggacagaggggcctggtaggctgaagtccatggggtcgctaggagtcggacacaactgagtgacttcactttcacttttcactttcatgcattggagaaggaaatggcaacccacttcagtgttcttgcctggagaatcccagggacgggggagcctggtgggctgctgtctatggggttgcacagagtcagacacgactgaagcgacttagcagcagcagcagcttaccaaagctccacagctagtaagtggcagagttgaccatatgcggaccccagagcctggactcttcagaattactttccatgacctgtgctgttgtcaacagaatcagtaataaataaccacaaacacttaaaaccctactccttgggtgagtcaaatcattgttcacgttacattttttttagccacagacttactctgcccagtaagtcccttagggaaaggaattgtttttttctctccggctgtaactccctcggtctttggcattgacctctctcccagtgggcatccaagaagttcagctggccaagtgccccttcccttcctctttatgacgtcgatgtaccccatgacgaggggtatcagcaccttgtcaaacgtgctgttttcaacttcttattttacacggaagtatagccgattagcaatgttgtgatagttttaggtgaccagcaaagagactcagtcatatgcatatacatgtattcatagttagggagtttgggatcgacaggtacacactgccatggttaaaatgcgtaaccgacaaggacatactgtatagtacagggaactccgctcaacagtatatggcaacttggatgggaggagagtttgggggagaatggatccatgaatatgtatggctgaatccttttgctattcacctgaaactgtcacaacattgttaattggctatgatccaatataaaataaaagtaaaaaaaaatatagctatgtccccctgttaccaaagggtccaaggctcaaactacagttggttaaatatggaatttgtggtcattttttatgaagaatttttacctaggctctgagtctggagtgcatcctttcaactaactggttgtgagagagatcagcattcatctcaaccaaatgacttcatttctagaaatcaacctgtcacaagtgtaaagattactctaaaattatttgcaatcacttgaaatcttgggattgattagaagtaagacaaaagtaaatagggccattttacgataccacgctggtagcaaagactctacacctaacgtggcaattgtgtgtatggtttctcattatattttagaatatgattttcacaagaataatttaatataaaattatgaccagattaatgatgcatgaagaaagttctatccagaaacaggtgcaggataacccaactagtaggacagtagacaatcaaacttcgccaaattatttgggtttatgtcccaggtggcttagtggtaaagaacctgcctgccaatgcaggagacctgggtttgatccctgggttgggaagatcccttggagaaggaaatggcaacccactccagtattcttgcctggagaatcccatggacagaggtgcctggcaggctacagtctatggggttgcaaagaattggacatgacttagcaactaaacagcacgctaaataatgatgataacaaatgtcattatgacaataaataggcattactattatcaagggtcattatgcatttaaatgggtgattgataccctggaacctattttcctactgaaactagccaggagtcagagaggcaatgttaccattatctgttatcattattgtcatagcttcgatttagtaaataaaccattactatctgctagatgttatgttaagcatgtgtcacacattttccaaatgtaactcctgtgaaaaagagaatgtcatctcttcttacagatggggataggaccaagggattaagtgatttgcccaagatggcagggttgggaaatgtccatctgaaatgacttcaaccctcctccctttattcccagatgtggtgtttcttcgctgggctatgtgcgccatccgctaggtgagtctgcctgcaaaatgatttaatgctgccttgcatttggaaaacatttagagatcttatctcgtgagccattccatgtacaagagttttgtgcccagaaataaatcagggtttctttcttgaaaaaaaaaaaaaaagtcaaaccaaaccagcaggggttggaacaggtggaatgcttaagccaggccagcttttggtctgttcgtcatcatgtctcaatttctgtcatgaaattttcccacccagaggctacacaaatgtcttggttgtggagagtgaattgggtcttttccggagagtgacacttcttccattgaaatggccgctttcttggatggggtgatgggggaatgagtgtgtgtgtgtgtgtgtgcgcgtgcttgtttgcccagtgaagcgggcattcaggtggcgcaatgctgcgagtgacttgttcggctatttgtgaagaagctggcaaacttggacctcctctctggcagggaggaaaaaggaccgcttgtttccgaaatatcagagaaaagcctggtgcaggtggggactccatcagtgaaatgttgctggaagccgcagctgcaggtgctgcccctggccatgaacgtgtacttcctgggtcgggctggagaaagagggctgccagtccccacacagaaccgcagtgttgtcccagcggtgaatgaaaaagatgtttcagtgctgtggatggatctgggtggtttgccacggaggacaaaaagactcctataaaattccatttacatagtcctatctcacttgggcttttggtgaccagattcaattgtgctggtgtcccctgggctgtgtgatatcatagcttcagaggaaggctttatttagaggtcacactagtttgtcctggggatgtagtcattttttgtgtcgcagacaatgttttactgtggagatatgagccagatggctcagccacttgcagtccagagctaaacagtatctgtattgttggcgaataaacagaatctattgtctccggctcatgaaactctagtgcccaccactgttgagagatgaagtatttaataaattgttaggtctcgcttaaagaatctgtgaaacaacatctcagaaggatgcaggcctccccaaatataaatcccctgagttcttaaaaaataccagcgccagcaccacctttccgagggctttcttcctgccctgccccacccccagcaactcctttacagtagccaaggccctgagttttctttctttcccaccgcaatccgtatgctaatatgatctgtaatccttgggcagcagcgaggtggggaaacaacacgatgcctgtgcctgtgccggatctcaaactttctcacccgctccgaagccccgccacctatttgtcagcctcgacagcacagtggagcctgactggggtggggagagagcttcggaaatgcagcttcggaatttagttcctccgtgcagcctgatggctgaggatagaaggtggagtgtctggtaagcgcctttcacacatggacttgacctcacaccgcagcgggaaatcggctcccttgctccaaacaacaacaaacaacccagcccagcgacacgggacggtcgcagcctctttctgtccttgtgaagacagcattgagagcatggctttctgagcatggaccactacctcccacctacgccatacaaccactgcccccacaccccgccaccaccgtctctctcctcttttccttccagactgcatcttgtccgtctaaatgaagcacactcttgggctgaacttcgcccagctgtggctgggtatattgcagtgtcagaagtattcgtttcctgctctaattgcagcccaagccaaccttgactggcaaaggagaaagcccctgacaggtttgggctgtgtccagacctcctcagactttctgtcagccaactgtttgacagtcaatgcaaatgcatgcaaatgaggggacactggccgaacacctgcagaaagtgaccatccccgcccgggcgggcctccccgtaactgggggggtttggaaacgccaccgctccgtgctccgtcgctttctgtcagttgattatgccgtttgtcagcagaactcggggcgggataagaaacggctcctctttgtcctgcagagcgcagagcgctccatgtggaactgtgagtgccaggaatcgggggatggctcccggccagcccttgcaagtcctcccctctgtctccgggacccgcgaggcagcatcccgcaggcttgtgggctcgcccgcggggaggaaggccttctgtctccctgggtgtggaaggacatggtgttggtggccgggcagctctctttaagcagctggaacttggcgactcagagcgggtagtgtgtcctggattttcaaaagccgggggaaagaaaaaaaaaatctgcccggcctgtcagggcattggaaagggggagagggcccgccacctcgagtgggaaccaaactgccagccgcacaaaccacctccagactgcgggaaggctgccaggcgggccggctcccacgtccactggctgcccggccggctcagccccatctgcccgggcctccgctggctctgacaaccactctctggaagggctgctgggaccagttcgtcagctgaagaaaagttgtatgtgtgtgtgtagcgggggggtgggctacggagcttttgaatttggccttttttgaaggtaaggaaagtgacccacccagcagggcccttgcaactgaggactgggggacaaaccctgggtcccaggatcgaggggtcaggcagggacagtgcacaccaatactctatgtggtccttaagcattccctaccagaacaggggaaaacatttttcattttgtgtgtgtgtgtgaaactgggctttgtcctcgaaagaacaggtcatttggggactggctgcacaaactaggaattctaaagccccctaccctccctacttgcaggttagaaggaccagaccttgacatatatcaagagcacctggacgtgcacgacctaaatataggatccacgatgtcctgcgtataggtccataaccaacccaggcagggtctggggagtaagtgggcagtgctcataatgaacagatgactgatgtcagtgtagatggctgatccaagtaatttagagtccaaagtggatttttcccccctaaagaatcattttgacattctcgctacttcaatcaaatcttcacccattctttcccgtataaagagaagtaaaaaatcaaagtgaagactgttaaggttttgcccatccaggcttttctctctctggaaggaagaagcatttaactgggcttcccaaaagctgccgtttggggacctggtagaaaactggactgcgtggcttttaaagcagacatgagttccctgcgctgagaccagtgtgggccaacatctgttgagcaccccagtcagaaccctgatgtataaccaaggggctgacgggctgcctggagccagggctgcataactgggaaacatcagcacaatggtgccaagggcttgtgggaacagtggttttccagatgctgacttattgcagagggagagaggcaagctagctcagaagtacctggcattggacacttgctgctgtggacaaactgaggcacaaaagcatgtgtgagaactcacttggggtcaaaccatcattgacaataggacccggaagcccagttcaagttccctccacatctccctttaattatgggcttcccaagtggcactagtggtgaagaatccacctgcccatgcaggagactaagagatgcgggttcaatccctggatctggaggatgggatggcaacccactccagtgctcttgcctggaatattggaatatatggacagaggagcctggctggctacaggacatagggtcacaaagagtcggacacgactgaagtggcttagcacacacactcctttcaattgtatcacacagtacgtacaataaggaaaactcctttggggataggatattataatcttaatttaattttacttattttttggtcacactgcacagcatatgggatcttagttctctgaccaggtaatcaaacccaagcctcctgcagtagaatcacagagtcttaaccgctggaccacgagggaagtccaataaggaaaactcttggtggaaccaaataatattcatagaatccaggggcatgtgcatatgaagatgatttaaactggaaagataggaagcctcaggaagggatggagatgtgatagggaggcctcccatcaagtgtgcttcccaggaggctcatggtaaagaacccgcctgccagtgaaagagatgcaggagatgcaagttctatccctgggtcaggaaggtcccctggagtaggaaatggcaacccactccagtattcttgcctggagaatcccatggacagaggagcctggtgggatatagtctatggggtcgcaaagagttggacccgagtaggcacgcacacacttgagccatgaagttttcagctgctttgaatacctgtgaaactgattttttttgtggttgtcataacatcagcagggaaggaaagccacaatgtcatgggctgagaggctgtggatggattttctcagccccagtgcctggcggacaggtgacaggatcctactccttagctccaaggcaagtttcctgggtaccagtgttgttttaccaagtggaaagagaatttcagcacaccagctgtaacttataatgtacaggcatctcttatttaaatgaacctgctgtttgcaccgcccccccccagcttttttttttttttaaaggccagaaagaaagaaaatgccacctaaatgagaccatttcgtttctcccttgctctctccctcttttaaaaataaactttagaacccaaggtagtcgtattgaaccagctttaatgtcttttcaggactgtgtgcagggctgtggtcactcaggcagcagtaactttgaaaaaatgacccgtctacacccaaacaataacagaatcccccttttcatgttggagacgcccacagctttctgtgtatcttcggactccccacgtagacgcaactgtttgaccagccttctactgaacaacttaattaagcaaaagaaaacgtgtcagtttctgccaacctcacaaaaacagagctgtgggggtaaaaagggtcggccgaattaacccacattcctgaaccggttcactaaagcgaagctggttttgcagccatgccaaggggaaccgcacactggatggccattcagattgatcaagacatattgtccggcagatcatactgaacacaattaaagctgtaatacctcggggcagctacagctcgggtgtgagtttagcttaatttaaaaaaaaagaaaaaaatcttgtcacgacacagtgcccaccgctgacattctgcacagttaaggagacaaaacagtttcgcccaccatatgaaaacagtaagttgtttttagtttttgccccctcgtcaatatcctgccctccttccctcccccttctccctctccctgaaagcacatgcaatatgcaaagtaactgtatgccctgcatgcaatttgtacatccagaccaaacccgaatttaatcttttttttatcctgagggcggggaagtgcccctgcctaaatccttctctggaagcccagaaagcagaggccccaggaatcctgtttcctgaccaattaaatttaggattttttttttttctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctcctgcgtgatacaggaactgtttgattaagaggcatttatgggacttccctggcattccagtggttaaactctgcccttcccaattcagggggcactggttcgatccctggttggggaaattaggattccacgtgccgcagcgtggtgcggccaaaaaaaaaaaaaaaaaaaaaacatggaaaagagaaagagatttgtgcttgatatctactgcaagtgttcttttggtgtggagatgtttccagttaaagattcaaatgggactgaattatcagaaggctgtagaggcagcttttgtttgctctcccacttggaagaaatccacaccacttttgcaagataagcagggcagaaccttgccagcaccttactgaaagactgggcagacagaagacaggggaatgggcagaagtttggtgtaagactaattaatacagcccctgtgtagggcagtagcagccacgagcatgcgctcgttacaagtgtgcagggcacaggacgacaggccagtgtggcttcttcttctgactttaaaacggtttctctcttgagcatggcattccacaaaaaatgaaaaatgcttcctgtgcagaaatttccacctgactggttgaaacacatgcaaaataatgccggtcaagaaaagcagagaacaccagtgaagaaatgtgatcaggagtttctactaatatctgacaattatccagagagctcatcacaaaacaattattttgtcctcagaatacagatgttttaagcaaaagccttcaaaactcaacacccacagcaaggatggcttattcttttaaagattccagaacatgagccacagttctcattggggtgctctaagatctaaacagggcttccctggtggctcagatgttaaagaatccgcctgccaatgtaggagaccctgcttcagtccatgcgctgggatgattctctggagtatccagacccagggatcaaacctgcgtctcatagctcctgcattggcaggcaggccctttaccacgagcgccacctgggaaagcccaggggtctctgtgctaccccacaatggttcttctggggcctgatggaaaatccgggcccaagagcttggagcgggcatcgtgctccaaggacacaccctctcctgcagggccaggcagctgccccgcacctcgccctgcctgcctccctgtcctggcttcctgctctcaggatgcctcacacatctcactcagtccccagaccaggaggtgctgtctcttcagagggcccaagtctgctgtctgtgcctcttacagcttagagcatggtctctggggctggttacaggggttcaagtcccctccctgcctcttcactgcagtctgattttagggtaccatatttgtgtggattttttttttaacacatggtttcccaatttaagtagcagtcagcaactatttgagtagactttataggcaagtagacttgggcttgagactttactccagcactttgctggctatgagaaccgggaaagtgaccttgctgaaccataattccctataaattatccacaattccatcacccagatttaaaccctgtaaatatttcagtgtgttaatttttttctaagcatgtattaattttccccacaaacttggaataattcagtgtttaaaaaattttgacttcaaaacagtgttttgcccagatcataaaaatcttttgagagaacaattctttctactcccctcctcagagttcaggctcctcagtttactcatctgtaaagtaggctaataatagaatttacctctggggctgttgtaaagcttgccttaatttacctaatgggttagaactgtgcctggggagtcagtgcaattgttaggattgccctgtgggtcttcagatgccttcagggttggagcactactttgtggattggagcacctccatgaggggctcaacaaaagtgccgggagtgactctccaaattccccaggacaccccagggctttccagctaagccagagcaccagtccctggcaaggatttccttgatcaaaggacagcagggcagaggctgaaggtgatctgactgttcttgctgcacagaggagggggaacaaagaccccgaggctcttagatcaccaaggggacccagccatctcccacaccgccctccaactcgttcacttcacagctaggaacagagatcagagacggagagtgactagcccagcgtcacacagccagggcggggaccagaagttgtccttaacccggggctgtctgtgtctaccatcagcacattcagatggcaagatatgtaacacagaacccaacacatccttactctcattcaaaatgtttcttgtcctgaactcatgatctaaactttaggcttgaaaccatccccacagggtttaacacacctcttccatgtcaggacagtctccactactgcccttccacatgtgtggaaataaaggatctaaaagtcggccagaggcagagggacacacacacatacacacacgatcccggcactgggcccatggacccacatcagctctggggcccccacagtccagcccctctgtgccctggagtctggagctgagcacaggggctgcgctggtgattagtggctgggaggtttcctaatgtctgagcttgatcggacctcttgttggatgaaatttatgacccggcacttcctcggggagacttcccacgtcgaattgttgaacactcctgaccttaccgccccaaacaagagaggagtggggaggggaggggaggggcgggagggcggagggaggacgcggagggaggcgccgcttggccagatgtcggaggagccgggatgcgcagatgcccgaatgacaacgtgcgtggcggccgccagggcgcagggaccagagctcccgagaacccggctctgtgaagggggctgcgagccgccggctgatacgtgcaaagcccacgtctcccccagtcctaagtgaccatcggcggcccgaggggcctcgcggatggaccggagcctgggcaggggtagggaactgcctgagcccagcttatgtgttgtctggagatgtcccccacccccaagccagccagtgccgtcagcgcaaataaagaattgctgagcctgggagagactttggttgaggcttgtcggtccttatatttgttttgtctttagctataagaaagtcctgaatgctttcaggggattgtcgctgctactgttttttcctcctagttaggggaaggacagacgcctgcagttgagaacctaggttcacagcttctcaaactgggctgcacggtggaatcaccttctacacatataacaacaaaaactgatgccggggtcccacctcgcagagagtctggtttcacgggcctgggtgtctgggttttcgaagcccggctgatcttgaggcccacggactcagttccctgtcagccctgcctgacgcttagggtctcagctactcaacagtgagagcctgaaaaatggacttgacctcagacttaccctggagaagggcatggcaactactccactgctcttgtctggagaatcccatggacagaggagcctggcgggcctcagcccatgggggttgcaaaaagtcgaacacaactgagtgactaacactctttttcagacttacacatacagatttgaagacgagaaggaaaaagaaaaaaggttacttactgggggagagtggcaggtagtaaataaaatagaataatttttaaattgagatataattgatgtattagtttcaggtgtggaacataatgatttgatatctacatatattacaacatgattacagtaagtctaattaacatccatcaccacccagttacttatttttttccttgtgatgagaacttttaagatctcctgtctcagcaactttcaaagaggcaatacagtatttattattaactatagtcaacacgctgtacattgcacccccaggacttaattattttataactagaactttgtaccttttggccacccttacccactctgcccaccccttccctcagtgtctagcaactaccgaccttttctctgtatctgtgagttctgttgtttgtttctgtttttagattccacctatacgtgaggttgtaaggtatgtgtctttctctgattgcttccacttagcataatgccctcaagttccatccctgttgtcacagatggaataatgtttgactagtgactcatctaagctgggcaaccatttactaaaataaaattgagctaaccaatacgtagtatgtgggggcgaggaatgagctccagttcccgatgaccagtgtactcagatgccccaacctgctctggcttcactgtggccccgttgcttttgggttaaagacgcacattctgttttttttttttttttaatatttatttatttggttgcattgggtcttagttgcagcacacaggatctccagtcttcacagcagcatgtgagacctttttagttgtagcacgtgggatctagttccctgaccaggagtcgaaccccagaccccctgcattgggagctcagagtcttagccactggaccacagggaagtcccaaagacgcacattcgtaagcaggactgtgacacacgagtccctcaccagcctcctcttggaccccatgaaattctcagtgcttcgtcctgcctccaagctttccacagctgccacgctcttcatgcaacaccccaacacccccacaacacatgcactttagttaaaacctactctttcttcactgtttacatcagatatagctttgctgtagcacaccccagacctcacagaccatatgaaatctctctgttatgtgtgctcactgtctcggcagttatcacatagacattcggtaaaagctgtctagctggttgcttaatgtctatctcacctgctaagatgtcagctccaggagacacagagcatgtgttattccttgctgtggttctagaaccaccgtaggactgtgataaatattggtcaagtgataacgatagaccacctttatcacttaaaacgaggccatccttggagtccagtcctgcattcacttgacttttgctggttcagcccagctttatatgcagcggctggcggttctgatgttctggcaaaagagtttggctccctggatctctcagctgctttattgttaatgcctgtgaacctttatatgtgtcttcatgcctcagtttactcaactgtgaagccagcagggggttacgtaaaaccctggcaacctcagaaggggcatgctacaaatttcttactttattcttccctgctgctactgctaagtcacttcattgtgtccgactctgtgcgaccccatagacggcagcccaccagactcctccgtccctgggattctccaggcaagaacactggagtgttgccatttccttctccaatgcatgaaagtgaaaagtgaaagtgaagtcactcagtcgtgtctgactcctagcgaccccatggactgcagcctaccaggctcctctgtccatgggatttgccaggcaagagtattggagtggggtgccattgccttctccctgattcttccctaggaatgctatttcatgtatctctgtcattttctacctcaaaaaactttattttttaaattcagtaattatgatttaatatttgcagaaattataatggtcagttggttgtagcctgaaaggatgacaaggcaatctggggctgatgacgttttaagggttttccataaattatctcctcttgtgaaatcaagatccaagaaatgtcataaatcctgggtcactatggaaaagcgagataggtccttagataatggctcttacagaattcttatcatgaaaatgcaaaggatttgattaaaaattcaaatcgtatcctacgcagttagctctgaaattttcttaagccctgagatacaaactgcattctttctgcccttcaaaaacaaaggaaaggctaatgaaactttagtgcaacaaaaagatcactttgaatttgttccaggttgactgaaggaagattgcagcttgtgtagccagttgggtggtggttccatgcagaaatggggaaagacaggaagagcctaggtttgtgaaaggaaagatctccagctttcagtgaggtggggtacacggtagtgtcataggggaaatgacagacagtgggccttgtccccgacccactgagatgattgggtaaataagcagccttttctccttgtaccgttttatgtttccaacttctgtgtgttttttttttcccttaattctttgcctcatttatatactcaaatgtggcattaaaatgtattgaatttgacactgaatattaatagtattaattaactattaatattaatagttccaggtttcatgaaactgtgtttcctgtgaatgagtgttagtcaccagttgtgtccgactctttgtaaccccatgaactgtaacccgccaggctcctctgttcgtggaattctccatacaggaatcctggagtgggtagccattcccttctccaggggatcttcccaacccagggattgaacccaggtctcctgcattgcagatgggttctttactgtctgagtcaccagggaagctgtttcatgaggttccccaaagaacaccctgattccccaggctctgtccaccccccaggaggaaggagggggcctcacattagagctttgagtgcccctagggcggatcattttgcttcctgtcgccttgcaggccaccctgccacctgcccagcctggggaatgagggaagagatgccggcagagtctctgagacctgaggatctggcgggggccccgcaccccatgggctgccctcactcccaaggccctccggctcctcccgcaggccacaggccgaggtggagatcctgcccctggcctgtggttgtcacagtcaccgccttctcagtcccctctggggcccagatgatgggcctcactgacctttcacacgagcacttcaggcctttgtgtggagtcattggtctccctgctcgtcctctgaaggcacagttgatgccgtgacaactgtcagccggccctgggcccgggggggcaacgagcctgcaggagctgtcacccagccttgggggaggccaggacggtggtcccctccctcccagcctctggggtgactgccgtccttgtgtgtgtgagtgtgtgtgtgtgagtgtgtgggggtgtgtgcgtgagtgtgtgagtatatgtgagagtgtgtatgagtgtgtgagtgtgtgtgggggggtgtgtgagtgtatgagtgggtgtgtgtgagtgtgtgtgtgtgtgtgtgtgtgtgtgtatgtgttgggtattacctgcccgtggccagaggaacaccagatttccccgggtgactagtccccaacaatgtagtgggaactcaggtctcctcctggttatgacttgactgtgcgcctccaagaagcgatcccttctctttagaccatctcagctgtgtatttttccttatctccaggtccattaggagagtaagttaaaaatacctccagttccctggagaagagtcctgtgtataacccagcgtgtaaaaagtacaaatgacaagttactaactatattaccactcttattgttaccagaatttctcaacgcactatatttccttaagcttctaagaccattaaaagaaaggaaatgaaatgatatgattctagttttgtaaaaggtgaaagtatgtcttctaactgtatatacataggaaaacaacctatgttgttttgagattaacagtggctatctcggggaagtggaatcacacatgccgtgtattttcttgctatctcagcatttctttccttttaacataaacctgcaatttttgtaccatcacattatggcaaatagaagaggaaaaagtggaagtagtgacagattttattttcctgagctccaaaatcactgaggatggtgagtgctaccaagaaattaaaagatgcttgctctttggaaggaaagctatgacaaacctagacagtcatatacagatgtgagatgtccataaagaagactgagcaccgaagaattgatgctttccatctgtggtgctggagaagactcttgagagtcccttggactgcaaggagatccaaccagtccatcctaaaggaaatcaaccctgaatattcattggaaggactgatgctgaagctgaagctctaatgctttggccacctgatgtgaagcactgacttgttggaaaagaccccgatgctgggaaagattgagggcaggaggagaaggggatgacagaggatgagatagttggatggcatcaccgattcaatggacatgggtttgagcaaactccaggagataatgaaggacagggaaccctggcaagctgcagtccatgagattgcaaaaatctgacacaacttagcaactgaaccacaacaacaagtattcttctgtcagaaagaaacaatattgttgttgtttttaatgctcatctatattctgtgtgtctaaagactagacattttctctactcctattccatctggaaatgcagcagttgcttttttggacacccgggggtgggtttaagaggggatttctgatctgacaaccactccaccttcaggatatgacttcaaaaagggcagagaaaagggttcgctgtcacaccacctgagccattgagggagagatgccacgctttccttgcctcagtctgtcttaataatcttgcgagtttgcctggatttctatatttctatttgacttgaccctctgtgctcgagaatgggcagaggaagtccccaggtgagcggtgacactgaaactttatgaaccgtcattcactggtgcccccatccagcttggtctgactgtaccattagtcagaggacccttagcccagaagtgcttgaggaagcacacacgtggggagggagatgggttagggtctgctcccatttctgggaaataagctatgtcagtcacaagcagcccttagaaacctaaagtgcattttgctcgttcccaccttgcttattttcctcactcttctaagcagagtgggcgtcttacaattgcctggagcagagcttgggtgaagggtcagagggaagtggcgcaagccgagaagactatggttggggacattttctcagtcactcttgtggttgggcaagctcccagggcacagtcactggggtttgcccagcttcgaagcattgattcatttatatacgttcatagtgtgttgctctgaagacaccctgcacggttccgagcttgctttctctgaaggcggacctcattcctcccctgcctcttcttcagggacttgtcctctccccaccttttccttaaatctcgtcagattgaaatcagattgtaacacactccagacaatcaacctattctttccaaggagggtgagtcaaactcagaaaatctctgtcaacatgaaggggcaatgaaaagaggaagataaattctccaaaaccgaaataatgggtgatattttgtctcattttaaaggcagaaaggacttccctggtggctcagacggtaaaagcatctgcctacagggccggagacccggtttcagtccctgagtcgggaagatgctctggagaaggaaatggcaacccactccagtactcttgcctggaaaatcctatggacagaggagcttggtaggctacagtccatggggttgcaaagagtcagacacaactgagcaacttcattttcaaagacagagaatctcatcttctgtccttaaaatcacttccaagtgtttaccgaatcatctcaaaaacataattccttttcaaaaataaatttctttttctgagtgtaaatgtaatttttaatggattaaaaaaaaatccatagagacttccttggtggcccggtggttaagcatctgccttccagtgcaggggacatgggctccagccctggtcctggaactaagattccatctgccccggggcagctaagccaaggtgcctcgactagagagaagcccacagaacagaagatcctgtgtgctacaactaagacccaatgcagccaaataaatattttttaaaatgtttataaaaaaatgattaaataccaaaaagagtaaaactcaagcaaaatccaacccctcagatataaacaccagtcacgttttcctaaatgtttctctaatagacacatgcagttagacatacttaaactcatactatacagaaattctacaacctgcagtatgttatgacatctttctctaatttatgtgtttatttatctaatcaactaaagctccaggtcattatttcaaatcatttcagattcagattattaaaatgtctgcaaggaattttactgtaaatgcacagcaacatttcttaatctcgttcctaaggatggacactttggtccactctgatttggttttaatatcaaaagcaactttgtgatgaatgccctcatacctaaatctttgagtccttaggctatgccattttagaataaattctttgaaggaagattgctggctcaaagggtaggatcattcatcatttataaatatgtaagtatacattcggagaaggcaatggcaccccactccagtattcttgcctgaaaaatcccatgaacggaggagcctggtaggctgcagaccatggagtcgctaaaagtcggatacaactgagcgacttcactttcacttttcactttcatgcattggagaaggaaatggcaacccactccagtgttcttgcctagagaatcccagggacgggggagcctggtgggctgccatctatggggtcacacagagtcggacacgactgaagtgacttagcagcagcaagtatacattatttaatgtataatatgatcgttataatacatgtaatcacaaattacaattattttatataggtatataaaattatatatgcaactattttacacatatagataaatgataattatatattacatatattgataaaatttacatgacacttttatgaactcaaaagccttttatctacttgagtgttgcatagaggcaatcacggctttaaaacactgtacttggacttgcctggtgttccagtggttaagaatctgcctgccaaggcaggggacatggtttgatccctggtccagaaagatcccatatgctgcggagcaactaagcccactctacaactactgatccctcacgcctcgagcctgtgctcgccaacaagagaagccactgcaatgagaagcccgtgaaccgcaaggaagagtaaaacccttgctggccacaattggcgaaacactgaacccagcaacgaagactcagcatagccataaataaataaatagaacactatatttaacttttaaattaaagtcatgggtgcttgaaatttcctagggacccactaactcctctaaaccctgagacagaattatatctcccaaacctcttaagagaactctcttgaacatgggcgtgcagaaggaagctagccttcagtagcaaagaagaaagaaggaaggagtccgtactgaaaaataactcacttaaacatgaatggacctagagactgtcatactgagtgaactaaatgagagattgacaaatacatgatatggcttatatgtaaaattttttaaaagggtacaaacaaacttatctacaaaatggaaatagagttacagatgtagaaaacaaacttatggttactaggggataagaaagggggagggataaactgagagatttcgattgatatagacacagcgctgtatgtcaaatagtatctattttacatagataaaaaatagtattaaggaccattactctatagtaataggacatactctatagcacaggggactctactcaatacactgtaatggtctgtatgggaaaagaatctaaaaaagagtgggtatatataactgactttactgtatacctgaaactaacacaatgttgtaaatttactatactccaacaaaaactaaaaacagaattaaaaaaaatctttgaaaagagaagaaaaaccaagtaaattttaaaattaaaaagaaaaagaataactcccttggattccatgatggtaactcaaacctggacctgagtagggaaaagcttcatttcccacgagctgagtctggatctcaaataatgaattctaagtcgaaggcagagaaaaaagtaagacactagatcactctatcagagattttctttttttaaaattttgttttatctttgcttcttcttcttcttcttcgtcttattgtcaatctgattatagccactctgttctgttgaccttttgcagtgttttccccccataatttgaaagaattaaaaattatagcatccacaaataaatagaactcttagctccttcttattaactaaatgcaatcgtggaataaatacagtgagtgttcacaaaaaaagtgaagaatagaaaattgtttaagtggccaaagaaactttatcctattgtatgacaggccaagctatgccagctatatgtaaatgtaagcagtggcctgtgttcctgtgtccactttgaagttgccatctgaatttaattctgcctttgtgattaaatcaggccattacgtttaatctcacttaatagtaaggaacgtcctttgttgttttctataggcaacatattctgcccctaacatatacagcttggtattcacactttactattaatccccgatggctcataattgcttcatctccaagccctctgtccaattcacaaggggctgattgcaaccattcttcccctatacattaatgcactgtttgggtcttgcttctttggctcagtgaaccccatcaagctgtccacattttctgggcatgtgggcgtattgtgagatgttaaattaaattctgtgtcaaccccccctaaacaccagaatctattagccgcggcaacttagctgattgacaagttgggactacttttccactcaaaatcctgcagtaaaaaacaacaggctgaatgttttgtttctaggtgaagtctggggtcttcttactgccgtcttttgctatttacattttcacgaccactgcaggatcagttgcaacgttgccaagctgttacttcatccgttttctgtttgtctcattgtttctctgggaaaaattattagaccccagagaggtaccattcattgcttgaaagctggaaattattttctccaaaaattttgcttttgagggtgagtctacagactccttcccttatctgtcccatgaattgctcgagcttagatctccgagagcaaaatactagttgaatgaacagccttctgtctttcctttttgcaactaaggtaacagatacgactaattttagtgatgagctttagaaagaaaagaggcttttctttccgccacccattcattagatagatgggcaatagttgctaagcttttcgttgtgctaatttaggaatactatcattaccaagttaactttgtggttccaaaagtattattagctgcttgtgtctaatgtattaaccacgtagattacctagagtttgaacagtagctgcggcgcacacatcaccgtctgggtcggcgaataagcttcacccagctgtgttcaatttcagcgttcctgctgcttccagggctcttggtcaatccacatgcctatttcattttttttttctgattatgcagaaacctcataaaagtgattttattttatatattatataactatgatgtgtatagttatataaattatcatctaaaagtatcatattcattacagaaaaatcttaaaaattcaggaaaactaaccattccaaatcccacagatgtggctgagtttatcattttgctatgttttctaggtatatttctcctctgtaacttacatgtgaatagactcataatctatataaaatgcaaacacatcactttttgaatttttaaaggattttattgttttaaatgctaaatcattgagtcactgaaaaaggtgtgccataaagttactaagaagctctcttatttcttaatacatttttaattttggaataattttagatttagagagaaattccaaagacagtagagcacttctcagtccgtttatccctcagtttgtttctctggttgttaacattttaggtaacagtggcacatttttcacaaccaagaaacacatataatttagaaaaatacaattttttaggagcaaacagttttttaacctgcttggcctgtcatttaaatgtgtgagtgcttagtcactcatttatgtccaactctttacgacctcatgaaccccatcgggcccgcaaggcccctctgtccatgggattttccagacaagaatactttagtgggtagccattattcctttcatttaatagccacgcttgttaccttagttccatctttaaaacgtgacatttttacaggaatgttcgatgacatatgagggtatttattaacgtgacaggggcttccctgggggctcagagggtaaagaatccacctgccagggcaggagactcaggttccatccctgggtcgggaagatgccctgaaggaagaaatggcaacctattccagtattcctgcctgggaaatcccatgttcagaggagcctggcgggctgcagtctataaggttgcaaagggttggacacgactgagcaactgagtccacacacactgtatataacatgcttatattatattatcataaggggcttccccggtggctcagacagcaaaggattcgcttgcaatgcaggagacctgggttcgatccctgggttgggaagatcccctggagatgggaatggctacccactccaggattcttgcctggaaaattccatgggcagaggagcctggcgggatacagtccatggggttgcagagagtcggatatgaatgtaaagggtacaacgaagtaacatatcttataatttcctcagaaaaaaatcttcaaaggtaaaattaatgggttagatcaaggttgctcatttatacctttcctgagtggtgatttacaagagctacaagaaaaaaaaaaatcgaattttactgcaggtggagggggaaccatggtggaaatgtgattctcagaagaaaagaccaatccttcatagtggctttagtgatcccctgattagatatttctgtttagtcaaacacgcaactacccaggggctcccacacaatgagatcgttgtgtacacatgtcgcggtttgaacaggatcaccggcacccgaggagcctcccagaacttggttggaaaagggaatcaaaataaaaatgaggagaaaaaaaggaggcatcacaaattgtcatttggtggatcaaaacccccatagctctagtgacaacatgttcaaaactataaatgagatacaagcagttataactaacaccaaactctactatttctcacccagaactgggactcaacactgaagatcctgctgctgtgtttctgggctctcaattccagtagacctttgagcttgatgctgctgtgaacttactataattgatacatctgaattatctatgagtgacgacagtactgttcttagtgggagctgttgttttatttttagtttattttacactaaataagctatgggattaaatgtgtgattttttttaaagctctgaaagcctttatcagttttaaaagaagacttaaaaaaaaacacaactgtgcaggataatagaaaaaagaagctaaaaatatctcaatgccctatagacttgtcctaacagcatgtccattaaaaataaacttcgcttgttaaataaaacgcacatcttgcatccaccaccctctacacttggagctgattttaaattgactgaatgccgcaaagtccccgagatctccagctagtatctttaatttctggaggagagaaaccaaacagtgaaggttctaacaggagtaaatgaaaacaagggccaggaaagcagaacaatgcatgatgaggtcataaaatactgagaagagcaccttgggtgcccgcgtggccccgtgaactggcccggcctatgttggaagcacgaatgcccttctgcattttgtagcccttggaattcctaagcaacatcctaccatcatttctttatttcagagcttaaatttggtagcagaaggagctatcagtaatgtgttcaacaggcaaattccctgatagagattctttagaaatctggggcaccatttaatttcagagtaatttggtttctctgtgaacaggcgatcacagagctcgattaagattgcaggtcggttcttgactctacgagcttcccttctgctctttctcatcccaactcctttcccactttctccctttcacaagcatccatggtgcaccttggaacggggaaggtgaagttagatctgactccaccgtgggaggaatcgcaaaggaggaggagggtgctgagtgatgaagagaagtgtgaaggtgtaaaaagagcattgtatctgcatcttgaagggcttggaggcctgtgacaaagggtgggtgacagagggtggatgacagggaccctgaggttgacagggcagaggaggggaacagcagaggcaggagaccccaaagtgtgggcgggtgtgagggaggggagggggtgctggccaggatgggagctgaagcagagactgaaaggggaaaagtgcaccaagggggtgaaattactgtgtttgggggactcttccatgcaggactttggctcatcagcctgagaaatgttcgtgaaaagctctcaacagaatgcaacgcatgtattgggcagaatatttgccttttggaggggctcccaagcttcctacggaagatggataaactaccagctaggtgtgtgtgttacccacatatttcaccccaacacaatcttaaagaacaccccaagggaacatttcctttctactgagctggaagattattttgagtctatcatcagcctgtttgtatcattgaagcgacattgcgtgatctagtctgcttatatgatataaataatactcgcttctctaaagcaaccatccctgggcccacagggaacttaggagtctcagaagagatgcaagactagaactccacgtggtagcctgagatgaaatcaggaaggtcctggcagccctagggtgagctgtgtgtgtgtcgggggaagagctgtgtgtcggggaggagctgtgcagggttggggggcccacagctgccaggagcaaggcaatcaggcttcaggataaacctgtgtgtatctatctggggatactgcaaaggccaacaggccaatggtgagtgctgtaaaccgtcagaggtttgaggtcagttgggtttcaaagtccatgtatctttcacacaagtgtttgacccccaaaccaacttttgtacacacaaactaaagcaatttgctttcaggtcttgtaaatcttacctgtcaggtgagataggaaagcagtattgggctctcatactaaaagagagacagtttttttttcccctccaaacatttatttttaattgaaaaattaaattacaaatacaaaacattaaattgaaaatacagtccatggaattctccaggccagaatactggagtggatatagctattcccttctccaggggatcttcccaacccaggaatcgaaccagggtctcctgcattgcaggcagattctttaccagctgagctacagggaagcccttatttatttataactgagatgaaattgcttcacaatattgtgaaaaaacagagacacagctggcatgggtggacttggcgggcattatgctaagttcagtaagtcaggtggagaaagacaaatactctgtgacgtcacttgtacgtagagtctaaaaaatacaacacactcgtgactgcaacaaaaagagaagtagactcacagatatggagaacaaaccagtggttaccagtgtggagaggggaggggagggggcaagatagggacaggggattaagacatttaaactgctaggtataaaataatctgcaggggtgtcccaggtggctcagcggtacagaatctgcctgccattgcaggagacacgggttccatccctggtttgggaggaccccaggcaccttggagctacaaaatccggacaccctagaacccgttctctacagtaagggaagccaccacaatgagaaacgcgagcaccacagctagagaggagccctgcccgctgtaactagagaaaagtctgagcagcaacgaagacccagcacagtcaaaactaagtaaataaatgagactatttcaaaaagggctctttataaaaaataaaataagctgcaaaagtacgttgtacagcacagggaatatagccaatattttttataactgtaaacggagtataagtttcattaaaattgtgaatcactatactgtacacctgtaacttacataatatggtacataaactatacctcagttaaaaaaagtgctaaagcctcaaaaaaagggagacagctgaaatacaaaaattagaacttccttgctgccgcctccttccctcccttttctccttcttttatcatctattaaccctacgatgaggcagcatggctcccgaccccaccccgggaggatttcagctattgtcagccaaacctgttttagatattcccagggcaattccttgaatacaggctcccaaatcagaaaaggctcctttctattcttacccttcttcgtggagctgaggttgggggaggccaagttttgctttatgaaaaaaaagagaggacccataatttctatgtctctctctcagccaaacccccaacctgcctctccttctgcaggccgtgggaaatctgtgtattccaggttactgtgacatggaagccccggtaactaagatccaagattgacttgctgcacttgattcaatatggaagagtgttttaaaacaattcaagcagaccttaaatgttggagagccaacctgagtttacagtttaacaaaacagtgtgtcccagaaatgagtcagaaagttaaccaggatggagctttaggtatctgtcaatgtcaccttggcttatgtaactaatgctgcctatttatctacctgtcaacagggagatgatgtcataagctgtttgaagacagagtttgaagggattggctttctcagcactggtcagcttgcacatttagagtgtgggtggaagccgaaagacctcgaagaccaggtgaggagctggggtagacatcagggagtggtgacgactgtggcttagagtcatccttgcgtggctccaactctctgggcctgcagaagctgggctcatgtatggctgtgccttccaacttttccaggggaatgcaagttctggatttttacataaaattttctgattctcaaatgctaacaactgcttatgtttatcatcttttattttattatcattttcaaaagtgtctttgtttttggttgtgctgggacattgcagctgtgctgactctctctggttgccgtgagtggggcccactctccagttgtggtgcacgggcttctcgtagtgggggcttctcttgtgttggagcccaggttctagggcattctggcttcagttgttgcagtgcatgggcttagttgccccatggcacataagatctttctggaccagggactgaaaccttgtcacctgcattggatggcagattattgaaccctttgaattcttcatcccctaccatcccctgcttctgctgctgctaagtcgcttcagctgtgtcccactctgtgcgaccccatagacggcagcccaccaggctcccccgtccctgggattctcctggcaagaacactggagtgggttgccatttccttctccaatacatgaaagtgaaaagtgaaagtgaagtcactcagtcatgtccgactcttggcgaccccatggactgtagcccaccaggctccaatgtccctgggattctccaggcaggagcactggagtgggttgccattgccttctccaatgcatgaaagtgaaaagtgaaagggaagtcgctcagtcatgtccaactcttggcaaccccatggactgcagcccaccaggctccaccgtccctgggattctccaggcaggagcactggagtggggcgccatcgctttctctgagtcattctcaaccaggtgtgctccctgtagaattctaaaagccatatacactcccagcctccacccttgactaagcttcctcgggaaaggaaatcagtcatgtatctgctttcttaacaattattttttattatggtaaaatatccataacaaaatttactcactggaccacttttaagagtacagttcagtgactttaagtgcactcgtgggtgtgtaaccatcaccatcatctatgttgactttttcatcttcccaaactgaaactgcatccattagaaaacaactaccccattcccacctcccaccagcccctggcaactaccattctactttctctctctatgaaagcaaaagcgaaagctgctcagtcgtgttcgactctttgtaacgctatggactatacagaccatgttctccaggccagagtactggagtgggtagccgttcccttctccagggcatcttcccaacacagggatcgaacccaggtctcccgcattgctggtggattctttaccatctgacccaccagggaagcccaaaaatactggagtgcgtagcctatcccttctccagcagatcttcccgacttaggaattgaaccagggtctcctgcattgcaggcggatccttgaccggctgagctatcagggaagccctctgtctctataaattcgactaactctagggacatacttatagagacagagggcttaagtggaattatacactgtcgtgtctggcttcttttactaagcagaatgcttttaagattcatccaagttgttgtatgtatcagaatttccttcctttttgtggctgaacactattcctctttctctctctctgtgcccctccccctgtgtgtttgtgtaaatacatataccatgttttgtttatgcatttatccaccagtggacttttgggtctcttccaccttttggctgccgtgaacagtggtgctatgagcttaaagtgtacacacgtctgtttattaagtctgctttagttccaaacctgtctgctttcaaaggttcactgatgattcaaacaagcgtccctctttcagaactactcttacctggtggcaaccggtctcatgtctgctctgtgtttaagccttatcacctgctctatcacaccaactgattgttacaagtcaacagcgagttcttgactctggttagcccagcagataaggaattaatggagggagataggctggctcactgcatccatgtggaggctgaaaaagcagattcctgggttgctgggacaagcaaggtcctgcctcaggaacaaccgactttggatgccactgctgttaccattgcagctggacactttctgcggcgcagctggtttcctccgctggactctggcctaggcagtgtttaaccacaccaacctccctaccactgaatgtgggtcacttgtggccaccaccgatatgctctagcaagcccctgcctctctgcctcagtctccaaattcatcgtcctctgcagggggatctgattgacctcacctagataacgagcccgagctctcggtgcctagcactggggagagggaatatatttgacttttggcatcctgtggcagtggacgccccaccttccatgtggctgggggttcagccccaagaggaagaggatttgtgagcactggtgcacgggcacttacggtacctgctcaccagaacacatgcgcactgactctcttccacattccaggacatcacaccagtagcttggaactgactgcggatgatgggagtacagacaccaggaaagtgaaacgaaagtgaaagtcactcagtcatgtcccactctttgcaaccccatggactatacagcccatagaattctccaggccagaatactggagtgggtagcctttcccttctccaggggatcttcccaacctagggatcgaacctaggtctcctgcattacaggcagattctttaccaactgttacagatcagggctttgttttttccctcagagcgtcagtttacaagcatgccaaccatctaaaccatgtaaccatctctttaatatttcatacaccagataaccaaagtgacaaaagtcaactctccaggaaaaaaaaaattcagtgatttctgcaaatgagattattgaacggagttgaaggaagaaaggagagagaacgagagaaaaagagaccatccacaaactctgggtatgtttctgtaggtataaagacagctcagaacagtgccatccgatagaaatataacttgaaccacaggtgttttatttatttatttggaaggaagaggtcatggctgacaaaacagaaaaaaggaaaaactcataagcatgtaacttgtgctcattaatttcagtttccaagtatctccttgcattcaaactaaacatggtcttttaatgcccaggcctaaactggtactttttatatttttgaatacccaaactttaatcttacactttccactttctctgctacacacatagatacatgtaatttgaaatttaaggcgatggcaccccactccagtactcttgcttggaaaatcccatggatggaggagcctggtgggctgcagtccatggggttgcgaagagtcggacacaactgagcgacttcactttcacttttcactttcatgcattggagaaggaaatggcaacccactcccgtgttcttgcctggagaatcccagggacgagggagcctggtgggttgccatctatggggtcacacagagttggacacgactgaagcgacttagcagcagcagcagcggcagtggccactttaaaagaagagaaacaggtgagattaattttagcagtgtattttatttaactgatgtgtccagaatattatccttccgacagtaatcaaaatttttaaaatattaaagagatggtttacattcttttcttcatactaagtcttcaaattcagtgtgtagtccacatttacagcacatctcagttcaggctaaacacatttcaagagctcagtagctgtacgtgtccagcggctgccatactgaacaacgcaggcttagagcagttcaagaatagcatggtcttcaaaccatctcccagtggtgagttgcaaggaataacttttattcttctctggcagatgtggaaaatcagaaatcccaaggttgcacaaacgtgagttacgtatttgccatttgaattggttgatttgggtagagagtgggtcagttcatacggacctttcttatgcatcaactataaatattgctgaaaatatctatataaacttgaaaatgtatgcacgcatggattgagataggagggggttggaagacaggacatgtgaagaccaccatgtgagcaaaggggtcaaagggttcccatggctctaccagactggtcctcacctctttccagaaaatatacctacaaaatacacctgccaaaggaaggactagaccctgtttatctcatagagacaggcagtctcagatattgttggcagaagtgttagctttggaggagtcatttgacaacagttattgacattttaaatgtgcaagacctttggcacaaatgtttttctaggaataaccttaggaagatcctacacacacgcagaggcatatgaacaaagatattcattcagatattgaaaacaactaaagcattcatccccaaggactggggccatgaattatagcatgtccagcctgcggaacacttggaaaccactgaaaatgagacctgtatttatttatttgtaaataaataaattactgataactgacaaggaaaagaagtcacagtatacacaaaaacacggaaagaaaaaagccagttgcaaaaaagaatctgaactgaaaaaatctgaataataaaccatttttgtaagaaagaaaaaatgttttctgtggcgatattgaaaagaaattttggattgggagtttgggattagtagatgcaaactattacatacagggcagatagacaccaatgccctagtatatagcacagggaactatattcaatattctgtaataaaccataatggaaaagactatgaaaaagaatatatatatatatatatgtataacagagtcactttgctgttcagcagaaattaaatacaacattataaatcaagtatacttcaattttttttttttaaaaggggagaaaaagaaactttgggaaaagtacagtcaggttatttgagggtatagggtggtaataggaggctttagggccagagcccttctttttaactttatgtaaatttataatatttgaaattttacaatgatcttgtattgtttgtataaccataaaaagatataagatgcaaagagacacacgaacatatttcaaaagaaaagtacctagtgagttcaaggctatgagatcacactttctcaggacatgaaggtgggagtgtatgttggccctaccttcccggagggacctacttgtcaaatgcaattaaaatcttaccaatgtgataactttctctctctctcccccactccccctttattaaaaaaaaaaaaaaaaaaactactgtattgaaataaaatacatgctgcgtacaatacattcttttgttgtgtggctggttcttggaggccttctcttattttactttattttatttttttagctgtactagggcttagttgctgcaggaaggatctttcatttcagcttgtggggccttttgttcttagttgcagcatccaaacttgtagttgcagcatgagcgtctagtttcttgaagaaggatcaaacatggaccccctgttttgggagtgcagagcctgaaccactggaccactagggaagtccctgataactttcaatatgattgatttcacctctagaaatttatcctaggataaactgttaaagggcacataaatgtatgcattcattacagtatgacttacagtagaaaacaccaagggggagaatgaaatattcatatataaggagttacttcgataaatcacagaacagcttgtagtgcaatccaggttaaaatggtgacataggaacctatttattggcatagaaagctgtctgcgatgtactgttaaaggaataaagcaggttacaagacaggtctgtctcgtttaactctgatctgtttcacatatctgactctgtttagagatgaacatttgtaactgtctgtcctgggggattgttagcagtggttttctcagagcagtgagatgatagataatttctattttcttctgtatgctttttgaaatggtctgatttatttaccatgggtacatctagttgctttgcttatttcagaaagtaatgaagagtcctgttttaaaaattgccatagatgagagcacgtcaaggcttaaagagtttacctatgaatataaagctgtgcaaggtaacagagctcaggagaggggcgctggttgggaacattctgatgccagtcaggctgcccagagctgcttcttatgcccctggtatgcccctggaatctgtgggcagggagctacctacagcactggaagtgttttcctctagcctcctcgacctgaccagagcagggacagtggggagtgggtggcacaggaatggccctttcaaattgggaggggggtcgatggtctacctacactgctctgtggagtctgggaaagtatcagcaacaccggtcctctctatatttaaacttctgctattctgctcatcgtagatttttgcctcgattctaatttttaaaaaatactgcattaaaatgttattgcgatgactaagctcttggggctccgttaaactgtgcatccaaagaagtgcctcactggcctcagccgagtcctgaccctccttgcttcttggcaccctacttcctcctaagatccaagcagcaaaaagccagtcttagctattttatttttctttgggagacaagcttaattcaccagaatagtttttttctggctgtatcctgttgagcagtgtaagatgatcgtttaattcatgagtttgaaccaaaacataatgatgatttaaaatttaatataagtccttctcccttccttccctctcgccttcctctctctttctgtctctcacttgcttccttctctctttcctgtcttccttccttcctttctcacttaacaagtatttctgatgaggcagactcctgaacgcaggcagaaactagctctgggccgcacccccttcgaggactacaagcactatttgagaaataaaaaataagagctgcaccaagcaggaaggcgctccccgggtgaacagaggcgtgatggttgagtgtgctgggctcactctcaggggaggagacccagcacctccctggagcccccgctggcctgagtgtcctttggctcccatgtacagagatgactcaggcagtgacttcattcaagcagcctggtgtttacgcccctcgccacaaaccagttgatactgtttggagctgccctgagctgacgcgaccctgggacagaatgacatccactcagcttgtggccattgtggccaaaacagctgaaatgttgtggcttctgaagaacccattgtctgccagtcgatcggcaggggaaggagaatcccagagccctgccccctctaccttggaagaattttttggctccacagttgtagtgggtcgtagctgggctctgagagccagcttgggaagacagaccccagtggagggctccctaggagaagcccctggaaagccacctttgggcttgagctagtgccagaaggagctggagattgcagaaggcagctttactcattcaagatggatttttacttggcaccatccaatgcggtcatgagccctagtcgtgaatttgcaagagaagatgggaatgaccgaggggacggcattgctttccgaagtaaccatcatcagtataataatcacgtcaacggtggatttctagcccgtggaagaaagcaagtagaatcaggaaaaacaaccaccattacaataggcactgtgctaacagtggacaaacacagcctcagaatccccagtgaggtggctcctggctttagaccttagattggaagagaacaaggtaccaagcatccaagcagcctctccaaggccagtgagtagagtaactgatggtgagccacgaccagtgggccgtgcatggactctgcacgaggaaaagagcactggggcagaaaggagatgggagaggaggttggcatttgattggagcacagcatgggtttcggggatggaggagctggtctctatccctcccacgggcacgggtctgccccaccagctcccttcagcacacacctccctcacacacttccgggggatggtttgtgtttcagagccaccaactctccctttatgtcacgttgggtctttgtgagtatcaaatacataagggcatcttctgatatgttcacggcccctggaaccacggattacacagtcgtgagtgaattccaaagttgtctgttaaatgagatgctgtgatgtccagttttatctttttcccctccactggtgatgtgaaaattgttggttttgcctcctgaccataactgtctctgataaagttaaaaaaaaaaaaaaaaaaactatgaagagccaggactgcacaggcagtgatgtaacaaaactgacaagcaagcaaacgaaaccaaatgatggcaatagcaacaaccaaatattccctttgaatggcaagggaggtagagaagacgttatcatgtcatcttgaaaagttttctgtatggattctgttaatacatcggctcaactctggatttgaagatctgaattagtgatcactaccttcaaagcttttgccctgcttttgatttttgcctggacgctactagccctggcaaagaccagggccactaaggtcttggaggtgcgggcgggctgtgtcaggtctgccttctgccccagctgtaatctcaaaaacctcactagtgggaagttgccgtatggggagctcaacccggtgccccgtgacaagctagaggggtggcatggggtggggacaggagggaggttcaagagggagacaaacgtacacttaaggctgattcacgttgttgtacagcagaaaccaacacaacattgtaaagcagttatcctcccgttaaaaaaaatcctttgaaaactatgaacattatagaatgtaaatataaaacttctaacagagaagatgactttgtctcaactgtggatttgattacaattaaaacattactactaaaaaataaagctacaagtgagatacccaaaacaaccacactaatctcagggcatttctaactcaagaaagaggagttagatggagcatcttttcactgtgtgctgggaatctcaacatcgcgtggattagacgcattagcagaatatcaaccacagccagacctgtgcccagagggagggaggtgggtaagaattcgagcttgagagctgaagaccaggaaggaaatcaagagggctctccctcccccaggcaaagcctcctatctttcagtgtctgcttctatgactttcctgaatgggcttcagcctctttagttcctatcttttcatgcttctgttttctcagctgtaaaatggggtaatagtatatagcatgtacaaaatgaagtcacttagataaaacgcttagaacatagcttggcacccacataaaccccacatagctctttcagcttcctgctggctcagaggtaaagaatttgcctttcaatgtgggagaccggggttcgatccctgggtcaggaagatcccctggagaagggcatggcaaccccctccagtattcttgcgtggagaatcctcatgaacaggggagcctggcggggtccatggggtcgcaaagagtcagacacgaccgagtgacacacacacacacagagctcttgtcagtgccacggtggctttcatccctgctctgccattcccacgaggagctactgcgctttcccgcctgcctgcccccgggtgaggcggcttttctctctctcactttccccacagatgcgttctcatctgatctcgttcttcttgagtctcctggttggatgactccggcattctctaaggagttacccgcattacttcgaagcttctggggacccaataccccttctggatcccactactgaggcctgtggggagccttgttctcccagccccgtcacctgcctctggctggagctccacgcgcaggtaccccggtccgcgttcctgtcctccaccccgggctttgctggcagccggcacttactacagaacagccttctggagaaacgtccacgctcaggaaaaacactccacccaaaggatgcccacgctgttgagaaaatcatggtccatcattatcagaacatcacgtgtcaccatggaaacacggaggtggaagcccctaagacccactttctcctccgccctgccacccttgtctgttcgcagtctattccctcctcttctgaacagtgctttctgaagccctgatgacaaacctgtaaccatcagagcatctcccaaagggtttgctttgcaccctggactccctcggggctcccgggcgagactgctggagaaagttcaggtggctaaaagtgcccccaggtcacctggcagggcactggccctgcatctgtcccttctggatgcagtctgcaggggcagaccggggcgctgagcagagatgctggtgggccagaggttttcagggggaggggcaagaaggatgagctcactccccaccaggactcctgtttccaggggacttcaggcccactgggacaaactgaggaagaagtttttgtctctgcaaagcaggtactggatcctggcatccccacctctgaccacctgtgtggccttgggcatatctcgtgagtttattcagtagggagaagggtggacagataaccccgagtttctgttgcccattggcactctgcaggactcagcgatgatctggtacctgtggcctttgtcccggctcaatgacccgctgtcctctgtggccatcgaggaaagccaagtgcccaggagctttcaatccaggcgtcgccttgctcccgggcctcaggcagcctgtaatgtttaaggtcttggttgtcccgatcttagagtctgagctctggcctgtcaccctcagctggaggcctaagggaaagttttctaactgcggggccagcagaaagaacttggcttgacttcagatcaggcatttcagcttttatgctgggcttagtttaaaaaaggacaaaatggaaactgcctgaagaagtcatttgcaatatccccatagataaaggacttccctggtggctcagatggtaaagcgtctgtctacaatgagagagatccaggttcgaaccctgggtcaagaagatcccctggagaaggaaatggcaacccgccccagtactattgcctggaaaatcccgtggatggaggagcctgatagactacagtccatgggtcgcaaagagtcggacatgactgagcgacttcactttactttctttcacttttcatagacaaagaggtcagtttaggtcttgagaattaacttgctaactcttgtgttcacatcctgcatttggtaggagaagctgcactttgcttggaaacaatgtttccctgaaactaaaatcttttttttttttttttccctgaaactaaaatctgcttgataaaagccaatctgtgttttagaaaaacatgacattttccaatctgtggcttattgagcctacatcagggaaggtgctaatcttcttattgatatttgtgagtgtgcagaagggaggggtaggaagctagaggggaaaaaaaatcctcctggaagaaaggcattttcccaatagatgtgttatgtgacacggtgagaaaaagctctttctaatcagcaccttgttcttggcaagatcataatgtatccttgtgtggcagcctccttctggctggcttcctttatggcttacgaggtccagctagcaggcagaatctttactgactgccagcttggacctggcctcacctgcactcctgggaagtcagcaaagactagatgctgctaaactgctaagttgcttcagtcgtgtccgactctgtgcaaccccatagacagcagcccaccaggcttccctgtccctgggattctccaggcaagaacaatagagtgggttgccagttccttctccagtgcatgaaagtgaaaagtgaaagtgaagtccctcagtcgtgtccgactcttagcgaccccatggactgcagcccaacaggctcctccgtccatgggattttccaggcaagagtactggagtggggtgccattgccttctccgaagactagatgggtgactcttaattagacccatatcatggaagcatcgttgttgataatctgaactttggtaaagtgaaatactttgcatgcttggggtggagcctctttcttgatgggaacgcttgccttctaagttatatattttacaaggttgtattttcatgcctggtataaccagtctccctgcgaggagaacacctataaatagaccatcactacaggttggggaaaccccacagcacactgaatatgtcctctgtttactgattgctcagctgggctcctgcacatagaacagcataatttctcagggccttgtgtcttttccccttgggtcctgttcactctcatctctgggatcacaagttggtggttgactggatgcagtgacctttttgggggcatcaagccacatgttcctctctatcatgcttctgaatcctggtgaatctttctcaaggagcctgtcttacacgctctttgctttcccaagcccttccaagaccagcttcaacttgttccttctgctaaaagcctgcctgcagatttcaaaaagcaactccttgctctacaacatacatgtccattcttaaatatggtgcctacagaatacactgccctcccatagacatatgtctaactttgcagaggtctaactttgcatttggggcactgtatatagttaacttttattcctcaggacgcctgagtgcctgctgctgctgtttttcaggatgcaaattcctttaaaatgtgagtctgctcaatggagacactgacatggagaacaggcttatggacatgagggtgggggagtgggcggggaggaagaagcaggtgagatgtatggagagagtaacatggaaatttacttatcttatgtaaaatagatagccaatggggatttgctgtatgactcagggaactcaaacaggggctctgtatcaacctagaggggtgaaaggggagggaaatgggagtgaggttcaagagggaggggacatatgtattagttcagttcagtcactcagtcatgtccaaccctttgtgaccccatggactgcagcacaccaggcctccctacccatcactaactcctggagcttgctcaaactcatgcccaaccatctcatcctctgtcttccctttcgcctcctgccttcaatctttcccagcatcagggtcttttctaaggagtcagttcttcgcatcaggtggccagagtattagagcttcagcttcagcatttgcccttccaaagaatattcaggactgactgcctttaggattgacctatgtatacctgtggctgattcatgttgatgtttggcagaaaccaacaaaattctgtaaagcaattatccttcaattaaaaaataaataaacttttaaaagtgagtctgttaatcttccttggcacactaagatgctacatgcaggtagataaataatttgatgatactcaaaacagccctacttatccttgtgaaattcactcataatctttggttctggaaaccatgatagggtttgattttttgataaataaaaaatcacatgtagtgtgatctttcttatctttccctataaagcttcaattaataagaagagacaggagggagaccacacacccctttctgccctgtggctctctgcttctcttagagatggtttcaaagtaaggatggcatctaggtgatatagttgggacgacgggaggaactgtttatttctaatatcctagaaatgtttttttagggagggggacctgatctggttttgattagttgttcattttctttctgtccatcgtcaagatgcaaagtaagcaaagacagccattaaatacacagaaggttacaattcaaatttagttataatagaagcctgtgacttttctgatggcagagtcaggaagaatgagatattcttccccaaaatgggttggaaccatagagttactttccctcacatcctctcctgcccatcctccctgagtaaacagacacttatcaaggatggtagagaaaaaaattccatcctgctggcactccctcccaccaatcccatctgtgttcccaaagcgaatgcttatttttcctaaatgtatacatgattcagactagccagtgtggataaaattgagtaaattgccttctctggcctttctttaatttcccgcaggttaaaggggacactacttcatccccacagtccccctacctttaaatgtggctggatttcattagtaactatgaatatttaaatactacatgtgagcaagttcacattccaatttctttatcacatcttcagacagaacagctttcttcacctgttagaacaaaatgatttccaaggtcacaatttcctaggagacggctccaacctgatttaaatgatggggggaacgctcacagctttgagtttctgtccactaagacagaaatggtagatttctgagaaagatgatgagatgtaaagtaagtttatcataaatatatttcataacccatttttcagaggccaaagttgtagtgtgaaaagacccacccccaccaagtttggctaagaactgattcctgggatccctccctctctcctcatccaccccttcacctgcctgccccttcagatgcccctcaacttgaccaacagttgacttcattggattagtttttacaaaccaggaagtcaggtttaaaccttttgatcagaatcatttaattattacccttcatcctgaggttctcaatccatcagggtatcaggacttttttattaacaaatcagacgaaaaaatgtaaggcccttacatgtttattttgttgattcttcacagcgcagggaaacaaagttagagagagaaaaaaaaaaggaaatgccagttaaattcggctgctatccacaaccccgaaaccttaaaatccaaagcaagctgctgaaagatcatgaagtcatcttggatgaagtaatttgctaacgtctataacaaaccaatgtagtttttccatcgcgaagcggccagaagacctgccccacgcgctggtccaagacccccgaacgcgaagggaccacgcagaagacgccaccccgccgtggccaccgcagcggggtccctggtccccctccctgtttaacgaggcagaacgttaattagagatcttgccttctgccaagccagaaaccgcgaaacgcattgttacctattttctttgagtacgcccggaagcccgtctgcggggaaaaggtggttgtttttaagcaagctcaaatgttgcctacgctacccccgcgggaagaggagacaaaaggaggaatctcgaggtccaaaccgcccttctcagaagatttcagatttaagagcgcatcatcgcgacaaaacatccggttctgcgattctcaaaaaactgcactctcatagacggggtatgaaagcgggctttccgatccagcacactcatcgacctgggaattgtcaccgcccctcccgcggtaccgcgatgccaaccgcctggccgccgagggtcggtctgtccgtctgttatgcgcgaggccgtctgcactgacagcgtggtctttctcggcttcccaagggtcagccagcctcctctaatcgggactggctgctggtgaacaagggcgcctgtgacctctggctgaagagaaggaaacacctccaagtctacccccagacccccgccctccgagagcagccccttggttccctggctcggcaggtgtaggcccaccgccgcacccgggctagcccggcgccctaaagtccgcatcgctcttgcaaaacgcacgactccaggaaccgtgagacatgggcgcggggtgaaggtgagagcgcgcacgtgagcgcaaagcagctggaagccacccagaaccctaaagagccccgacgctctgtcgaacatccgctccggtcactttaatttccccgggatgggggcggggaaggggacgcccagcagtccctgtctctgggcgaggaggtccgcagtgccctcctggctctgctcggcttgggcggcgggaggccgggccgaggtggcgcccgagccggccctcacttggagaactgcgccggcacagcggccaagccaaggccggccgggaccaggtgcgggaacttgcagacggcgcaggtgcagaggccagggccgcccgcgccgccgcccggaccgccgccggggagcgcgaactggccgcacggcggctcctcgagcgccagcgacaggtacttggccgggcgcagcgcatcgggcggccccacggcgccgggcgccagcagcaccgagccgggcgcggcggcgagcagcggcaggccggccagcagcaggcgcggcgcggcaggccccgcgccctcgccgagcgcgcggcgcagctcctgaagcgagctgcccagcagcaggatgtagttgcgggctagcagcagcgtggcgatcttggagagcttgcggcctggagcgccctggcagtgcgccgccgagtagggcaggatgacctcgcgcagcgcgtccatggccaggttcaggtcgtgcatccgcttcctctctctgctgttgatcttgcgccgcagctgctgttgctgctcctctttggcatcggcccggggcccgccgcccgcgtgcgccccagtcccgggtcccgtgcccggcgtgtcggcgggcgcctccggcttctcgcgcgcagccttggggaggagcgcggcccccgtcggggaggaagaagaggacgaggagggcggctgccggtagcccaccagctcgtagagggaggccccgaccggcacgtctcccggcctcggcggccgcagcatgctcgcgggggccgcgttcacgcgcgcctgggaaaccgcataatacatctgggggaacgctgggggcggccgaggcgcccttcaggaacgccccggggtgggcctgtcggcaggccgccccgccccgcagacctgcgcgcggggagcggatggcgaggcaggagcccgcgcgcgaccgctttaaacccggcttgggaacctgcggggtcgcgggctgcagggcgcagccaatgcgggcgcgaggtgcggctccggcgcgtgctcattggccgcccgctcaccccgggcgggcgccgaggtaccgctggcgcggcttaaggagattattgtgagcacaagacggaaaatcacaggacactccacccgctacccgcctacccccgccccaaccgcgggatggagggaggcagggacgcgcgttttcgggtggagtggggctcttggaggactggtgttgggatggtggggctaaagctcctgtctctctgtctctgcttttttttgtatacgtatgcatattgttgtttgttgttcactcgctcagtcgtgtccgactctttgcgaccccatggactgcagcacgccaggcttccctgtccatcaccatctcccggagcttgctcaaactcatgtccgttgagtcaatgatgccatcccaccatctcatcctctgtcgtccccttctcctccgaccttccatctttcccagaatcaggagcttttctaatgagtcgggtctttgcatcaggtggccaaagtactggagcttcagcttcatcatcagtccttctaatgaatattcaggatacacaatggtttgttttaaattgtggtcaaatacacataacatctaatctagcgtcttaaccatatgtaaccgtacagttgcatgcaggcacattgctgtgcacccaaatccgcagaactcttcgtctttaaaagctggaattctgtatgtactaagcagtcccccatcctccctgcaactcctggcaaccattattcctctatgaatccggctactctaggtacctcctacaggggatcacaccgtgtttattttctaatgacccttgtttcagtagtataatgtcttcgctgttcatcccagctttagtgtcaggatttcctttctttttaaggctgggtaacagtccattgtatgtatataccatgttttgtttatccagttctctgtagatggacatttccattgcttccatgtttttggccattgcaaataaagctgctatgagaatggttgaaacaggtgttttataaatatgtgattttcttcaaggctttgagaaccaaatttctgggctcaaggaccagtagcattagaatgtttacttccagcctctttctctcttctctttctgattaaaaagggctttagggactaaggagcttctttcctaccccaaagggacacgtattcactttatcagtgactcgattcttggttaaacaaaaacacagaaatctgccttttatcggaaaaaaaaaaaaaaagccagccaaaataacaaaacagcaactcacccacacactcgtatctgttcagggtagaactgaacctttctcttccctaaatgaaagagcatcgcttggtggctgtgagtgttttcttccccagcaccaggggatactactgcagcttgtcatcatcccacgggagagtagcataggctgagtaccttttggtatctaaaccttcactatccactatggtagccgccagcacctgtgcctgttacaatttaatttgctaaactaagatgaagctagaattcagttgcttggttgcactagcattgcctcaagtgcttagttgtggctgtcatggccatctgttggacagcacagagaacactgcatcatcacagagaggtctactggacagcactgatgttgacgctaacttcgagaaaatgagcttctcccccgtggtcccctttcgtgtaagaagaaggatgctgttgaaggacctatcattgcagggactgatttcagctctcgtggtccattggctgtgcttgctgatttcagggctgttttgttccgttttcttccattaacattctccccgtaggctccctctgacctttggcttcttttttattgttgttaatttttatcacagtatagttgctctacaatgttgtgtcagtttctactgtacagcaaaatgaatctgccacacctgaatatatcccctcccttttggatttccctcccgtttaggtcacaacagtgcatgaagtagagtgccctgcaccacacaatatattcccatcagttctctattttatacatagtatcagtagtgtatatgtcagtccccatatcccactttgatctttgcttctgacctccagttcagtacagttcagttgctcagttgtgttccactctttgcagtcccatggactgcagcacgccaggcttccctgtccatcaccagctcccagagcttattcaaactaatgtctgtcgagtcagtgatgccatccaaccatctcatcctctgttgtccccttctcctcctgccctcaatctttcccagcatcagggtcttttccaatgagtcagttcttcacatcagatggccaatgttttggagcttcagccccagcatcagtccttccaatgaatgttcaggactgattccctttaggattgactggttggatctccttgcaaaacaagggactctcaagagtctgacctccagttttgcgtaacatcctgtccaggccttgggttcagctccaatttactttcttctcaaagtcttggtgatttctcatcttcttcccctcatcagtcttggcaaaccattggcagcttttccctgtagcctagattgtgttatgtgtaggttatccctgcatttacttgtgattgttttgagggtgggaaccacttgttcatttctttatcctcccagagctttgcaacgacagtgtgtcctgggggtgtctgagtatttggtttgaaatctccactagctcacaggttcctccttgaaatgtgtgaaaactccattggaaaatggagctttaatccaagagtttcccctaggcttcacagagagtcaagggtcttggtaggatctggtaagttcggtttaaaaacgtggtcccaataaaatgatgcccaaatccacttgaggagatgccgtggagagcaggaagtaaggacaacctctctctnnnnnnnnnnnnnnnnnnnnnnnnnnnnnnnnnnnnnnnnnnnnnnnnnnttaaaagtaaactccgggagttggtgatagacagggaggcctggcatgctgcagtccatggggtcgcaaagagtgggacatgactgagtgactgaactgaactgaactgacccgcttgaaactttcaaggtgatttccttgatctctctccttcttgtccatataattctgcaggggactcagatcctttctgaggcctcttcctctgtccctaagtaagtccctcaagtgtgctaggggatcctacaaagacccctcaagcaggtaagtgtgtgtgtaatcatttgcccttgtgttaaggcatcctgtttctcaaagcattttcacagacacttgcatttgactctcaggggaaccctaagagctgagcatttttaaaatccctgctgcggatggtgaaactaaggctcccagagggtgatgagtttctggggttgaggattaaccttcagacaggacaggcagagctgccccatcggtgaccagcttccagaattccctccagctggaccaggcctccaggaagctggggagggggccatgatgaggagggttggggacggggtgaaaggctggaggagacagcctgggccaagccagtatggtggagttgatgggttcgggcttgtcctagaagagagggctcctgggatcccacctacatggccctcctctagcaaagcttgccctcaccctgaggaccccactgtcctgtagccgaggaccctctggcttcctcctctgcccacatcctaggtgtggaccctggggctttcacctgccagcagaaagagaaagtggatgagaaagacagaagctcaaccaaggaaagtgaaagtgaagtcgcttagtcgtgtccaactctttgcctaccaggctcctccatccatgggattttccaggcaagaatactgaagtgggttaccatgcccttctccaggggatcttcccaacccagggatcaaacccaggtctcctgcattgtaggcagacgttttaccacctaagccacctgggaagctcaacctaggacagtggcttaaaaactccccctccacagacaggggtgcccagggatcaaagatggaaacacacacattgctcttccccacaaagggcccctcttccctggaggtgtccctgatggttctctttagcgccccctcttttttggtcaattgctaagttgtgtccggctctatgaccccatgacccacagcacaccaggcttctctgtccttcaccatctcccagagtttgctcaaactcctgtccatcgagtcggtgatgccatccaaccatctcatcctctgtcatccccttctcttcctgccctcaatctttctcagcattcaggtcttttccagtgagttggctctttgcatcaggtggccaaagtattggagcttccgcttcagcatcagcccttccaataaatattcagggttggtttcctttaggagggactggttggatccccttgtagtccaagggactctcaagggtcttctccagcaccataattcggaagcatcgattcttcagccctcagctttctttatggtccatctctcacatccgtacatgactgctggagccctgaacctccccagatctctgtcctgaggaaggagggatcccttcttctacccgggacaccgtcagtaggacctgctggtcagtgcatattaaagtgctcttgcccgagccctaggagagggctccgggtagctgtgcaggcctagcatgggcacaggacttggtgcctgttgaagctggttacttggatgccccttctgctggagcagagctccagcggcatgcagagtgtgacagctggcaagggccagcaggccattgtagcccctggcaggagccccgtgggctggctccaggggagccagctgcagtggcctaccacattcaggacatgcttggggagcaacttacgtccgccataacaacgactcttgtctttgcctaaagggtgtgtgtttgtgtgtgtgtgtgtgtgttagtgactcctttcaccccaagtagatacgtgtggcaggcttcatttttcttgcatagaaacttaaaacatcccctgcctgttcccccaaacctgccttccacccttgctttgggtggagaagctaaaatttttgcagtggcagacgatgggaccccaaagcctcaatgggtgtgtggtaccacccaccacctctgtaagcacagacaggctgcgaagtccccccgacttccctggagacagtgccttcttgaagaaggctagctaagtgtaaaaagtcatctttgctgaaacgtgctgttgaaactggctggagcttgacgtgtaatgagaccagggttcactttaaagtgctgctttctcctaagaagggcagaattctctggaaagcttccattacccaagaggtgttgacgtgtatgctgtggccctgtgagaagtggccagcgcgtctctgtttgccctgttattagcctccccatcctgtccatgcagatctccgcccagaacacaggagacagggaaggagctgcagaaggcagggggcatggaggagagaagcagagagagaagacagggaggaggcggctgacccttggcaggttttcttggtaaaacagagatccctggacacgtgtggatacctctcagctggggaccatctcaatagactctaagtcatgcttagcaacagttctgattaaatacagattcctactgggaaaataagaaagaataggcattttgttcagttttaaaagggagtgcaagttgatccagttgttatgacctgatacgttgttagtgtgtgtgtgtgtgtgttaatcgctcaatcatgtctgactccttgcaaccacatggactgtagcctgccaggttcctctgtccatgggattccccaggccagaatactggagccattcccttctccaggggatcttccccacccagggatccaacctggtcttctgcattgcaggcagattctttacccactgagccaccagggaagcccatacatacagtgttgcttgaacgctctgcgacggtcacaagtgtcccccttccagggaggaggggcgcaggcagcagtgcctggtctctgttgtggttaaaacattacagatctaacgctgaatcccgttgctgcacagcagaagctaacacaatgttgaaaatcaactctactccaataaaaatggatcatcaatgtaacgggtgtgttttgcacatattgtaagaaggtttattctatttctggtaactgtcatctcaactcaattttaatgaagtttactacttcaaaattactttttaagtccaaatgtgtcccctgccatcttctctgtggaaaaaagttaaacgaaaagtaagaaaagaaatgagatagcatttgagtttttctttttcagatttccttttaataacaaacacttgatctggctgttggtgacagagctcaagtggatgcatagatgttttcttttttaaaaaaaacacagagtgatttaacagaaatagacattttcattgcttctgtgagtactgaatgctgaaattctatatgtcacctagagcaacatagtaacacattttaataactctcactggagttctgaaaagaactcctccttcaaagaaacttccaataatcattgtgaaaagcctaagaaaagagaagtacatctttttgtttcaaagacaaatggagatggttcctgctacatcaaaactgagaagcccattaaccgaattttaggcagagaaatgaaatataaccaacaggaatcttctgagtaagtgtggtaagaagagctgtcaactaagatacatatattagcccatgcagcttagtgtctgaagggctggtttggggccgaacaaaaatattctctgagtctctccaaagtcagtagctggagccaaacgtttcaaaggcttacactgacacaatgaaaagagacaatttgcttggaaggctgtggctaatttataacacaatgtccaatgtcatggttagttttgttgcaaaaatttggcagtttcacccagtctcaggcagcctgaaaagatgtgagcgattctggccatagcatctcccactcgcgagatgttccaaatggttcaaacaagccctttcatagagacgcgggggccaagtgtgctcaaaggaatgagggaaacaaaggtggctctgaagtcatttccccgcactgggtccagccatccggtttcactctttccccattgaacaggcagaatgcgacaggaagagcccggatgaaagggaacaaacaagctgatgtgtttggggagagaatggagagaggccggggctctgagctgctaaactctcattctaggttttcagaagggactgaatgatgaattatagaaacctgaaaggtaataaaatatgggtcactgaagcgctgaggccaagttcctaaaacacctgcagagacagaaggttctagaagtcagcggggccctgcagtcgcccgggcagacaccctgcccaaggcacagaaggggactgtttggaggctcacctgttgttttcctgttggctggcagtccttccccatctgcgagagccagcggctggatctgactccagattagaccaccaggaggggagaaagaaaggcagtgtgcagacttcccagggtgcagttaaggagactggagctggggggccacctccttcctctcccgaaggcgctctgacctggaaatgtttactccggtgaagacatccgcgttgagcatgcaaatctcctcctctgaaatagtctaaggcttttctgctcaaagcctcagcctgtttatgtctgacagagtcctgatgcctggctggtggatagcagctagcctgtagcctcaggaggacttatttgagcctcagtttcctcatcagtaaaatgggaataacagtgtttatctcctagggctgttataaaagttaggagaaaatatgaggaaggtgccatgcccagagtctggcacatagtagctgcttagtaaaatcataatgggggggcttcccaggtggcgctagtggtaaaaaaacccatctgccaatgcaacagacataggagacgcgtgtttgattcctgggtcaggaagatcccctggaggaggacatggcaacccactccagcattcttgcctggagaatcccgtggacagagaagcctggtgggctagagtccatggtgttgcaaagagtcagacatggctgaagcaacttagcatgcatcaggcaaaatgataacagtagctaatattattgagctttcgccatatgccaggtaccttggaaggccttactttacggctttcattcagactgcgatggtgttccagatcagactgcggtggtgttccagacgtgtttgctttaggcgagtgctttctctggaccacggatatggagtttttattcatttatttctggttgctctgggtcttcactgccgcacatgagctttctctagttgtggcaagcaggggctcctctcaagttgcaatgcaagggcttctcattgcggtggcttctcttgttgcagagcatgggctctgggcacacggactcagtagctgcaccttgcaggcttggttgaccttcggcaagtgggatcttcctggatcagggatcaaacccatgtcccctgcactggcaggcagattcttaaccactgcaccaccagggaagtccttgcccacgaacaacgcacatgtgcgtttgctccccctctagttcagaggctccacgggagtggtgttctcctctgtgccccgtgccttgagcagggctgacccctccctattaggtgctccataaacacttgaatgaacgagtgggctcactgccttctagtaacttctaatcaacttgagggcacggggcagacacatctgaacctctgactagccgtgtcaggttatgggatatggctgagctgggagggcatcagagctgctatggtccagagcacacggagccaccaggttccctggtggctcagatggtaaagtgtctgcctgcaatgctggaggcctgggttcaatccctgggtcagaaaaattcccctggagaatgaaatggcaacacactctggtatttttgcctggaaaattctatggacagaggagcccggtgggctacagtccagggggttgcaaagagtcggacacgactgagcagctaacttgacttacagagcctggagcagggagccagtggagcccgagatgctgagatgctttagcgcagtcagtgcacaggtggtaccgattctgctggtctgagaatcagggctcggaggatggcgaggcgttaagagtttcgaagagggagcagttgctcatggttgaggcctcttggaggagagtttggtaagcagggggacctagagggctggttgtacagaggagacaggagggcagggggccggccagccccagggggtggaatgaagaatggggacagggtggaaagacaagccgagagggcggcgggcagggggaagaggggcagagggggacaaccgccagccacagccacggtgatacgcaccctctctctgccgtcttccgtcttcaaaagcagttcgtggaaggattgagacaccggcacgctgccttcctctggcctgtcagttagtccaaaacatgttttcagagatgtcacaacccagggttgccccacagggactggtggaggggacagagcgagctctgagctgctgaagtgtgcgggcagatgtcttgccggggcagccgcctggccggttctcaccactgggatggctgtgtgacctgcccatggaccctcttgctcttttttttttaatttaatttattttaataaatgctttggctgtgttgggtgttccttgccgcacatgggctttctctggttgcagcgagcaggagcggctctctggttgccgtgtgcaggtgtctcattgtgatggcttctcttgttgcggcccacaggcttgtttgccccatggcatgtggggctcattggaaaagaccctgatgctgggaaagactgagggcgggaggagaagtaggagatggttggatggcatcaccgactcaatggacatgagtctgagcaagctctgggagttggtgatggacagcgaggcctggtgtgctgcggttcatgcggtcacagagagtcggacacaactgagtgactgaactgagctgatgtgggatcttcccacaccagggattgaatccatgtcccctgtattgcaaggcggattcttgattactggaccatgagggaagcccttgcccttatttttttgctaaccattttcacatctgtcatctcctgtgagccttacggtattcctgcgaggttgagagggcagctgcccattttgcaggtgaggaaaccaaggcccagagagagcggacgcccgtctagtctcacttgggtgcagagcccagactaaaacagccagggaggaactccgcttctttcacctggtgagtcctgccttgatgggcatacacgttagtatgcagacaggatggagatcaggagactagcagttcttcttcctggaaaaagccttccaggaagcgtgtggaatgatgagttcatagtcaccaggatgggaccccatccaggttcccagtcgctggaatgccagaatgttctagaatctcccctgggtggacttggcctccgtcatctcctcccactaatgggaaggaaaggggtgcagctgtggcagctggatctgcttcccacattgcctggaggctaaggtcagggccaatttcatgctccttcatccctttttatgacccttgtttccctggcacatggcagctgcttgagtccaaatgaggagacaggaagtattatattgtgttaacactcggggagagcagcaagaccatttattagctcgcttgattcctcctgatttaacggtggatccatttaaagcgatggagggtgatcagggcaaggttttacttgctttcgtaaagcagggactcgcctgcattttcaggttcttggccgcgcatccataaagctggactcctgggccctttgtcccagggaagaagcgaggcagctcgtggccttcaggtgtaaaatcctgcggtgctgtagcagggaccaggccagcagtgttgcgggggccagcctagattgagacacgagcttcgttccatctcctgtgcccagcgtggcccgagccagctggctgctctcctgcccctgccggcttcttctggtctcctccactgctaatctgcttgctctgagctagcgtcgcagagagggggcagaggggtttgctgcggctcgagaggcctcgccatgccccctggggtgcaactgctctcggtcaccccctgcgtgtctcctgctttcaggccaccacaccagtgtggcttcatggcctctgagtcagcaccgcacacatcaccctcaatcatacgcagcccagactctccaccaaccgcttctcagtaacatctactgtgtgctcagtccctcagtcgtgtccaactctgtgaccccatggactgtagcccgccaggctcctccatccatggggattctccaggtaagcatgctggagtgggttgccaggcccttctccagggggtcttcccaacccagggatcaaacccaggtctcccactccacaggcggatactttaccacctaagccaccaaaaaagcccaaacaaacgaccccgaagggacacgttatccattaggctatgcggccaacatctattaccggttttaatttttgctcccttcctttcctgtccccctctctggctcctcgcttcatcacacacagtcactcggcacaaagccagcaccaggccctactcatgtttccccaaacccaccccctctacccccacccatccccaccatcctggtaacagaattcaccctcttccaatacacttttcacctgagtgtatctttgccaatggtcactctgtatcttctaggcacatgccatgcctgccccaacaggacttccagggaataaaattctgtttattttattgcactaataagagagagcccacctgccaatgcaggacacataagagacacaggtttgatccctgggttgggaggattcccctggagaagggcatggtaactccctccagtattcttgcctggagagtcccatggacagaggagcctggcaggtgctgctgacgcaggaggtgcaggtttgatacccagggagttaagatcctacgtgtcacgtggccctggtgaggagaatgtaagcaggtcaggttggtccttcccactcaaaagctcatggaggctttccaacatacttaggatggaatccaagggcccaatggctccactcaattctgcccttgaatttttcgtgtttggggaaccaactgccacttttgaagtctggcgcctgttctggagggcccctggaagacagaggcctgcctcttgacccctagtcctgcctctcctgcatgcccagcatccctgccctgcaggtgccgtggaccttcctgcaacatccagccctgtccccgccttggctccactgtcccctggtttgctctcctgcagccccttcctggcagagcctctcggtgctcacccttctgccgatttcttctcccgtcatcttatccctgctgccttccctgaccctggaaacatgtggtgaccatcacgcctttgcccttgagctttgttttctttcttattccaacgtgtgtgtgtgctccctcctgtctgcctctttgtgaccccctggactgtagcccatcaggctcctctgtctgtgggatttttccaggcaaaattactgatgtaggttgccatctccttttccaggggatcttcacaacccagggatggaaccagcgtctctgcattgacaggcagatgctttaccactgcgccacctgggaaacccttcctattccaaatcatattatacataattttgttcttgcagcctaggatggtgcctggaacatgtaaactcccagataagtacttgctgaatgaatgaataagtggatcccagccatcatgttcctctatcaccttcagactgttttgctgcctaaattagagactttcttaagacgcttttgtgactttaggaaacaacatccatagtggatttggtgcatgtgtgctaggtcacttcagtagtgtctgactctttgcgaccctatagactgtagcccaccaggctcctctgtccatgggattctccaggcaagaatactggagtggattaccatgccctcctccaggggattttcccaacccagggatcgaacccacatctcctgcatctcctgcatgggcaggcagtttctttaccactagcaccatctgggaagctccagtggatttggtaactgacccctattctctctcttcccagtttcctgggttactgcacagcctcagacagccagcgcccatctgccaccagcctctgattagcactggatgccaagttctgtgggaggtcaactccagcctgtcgagaaagcagccaaaccttcccttctcctctgctggacctgtgtaagtcccactgaggggccggccaccagacagcctcgcatttctccttttggacttcctcctgggctgttagcaggattgagcaattgctttcatgctgcaagctgcttttgttcacttttgccccggggagcattttcattccttggttggatggtggcatcagtatgtgtccattgccagtgctcctgggtggctgagaacaaatggctaaccctcaggatcttgaggcttccctggtgactcagctggtaaagaatccgcctgcaatgcgggagacctgagttcgatcctgaggttcagaagatcccctggagaagggaacagctacccactccagtattctggcctggagaattccatggactgtataatccatggggtcacaaagagtcagacatgactgagcaactttcactttcaggatcttgagaaataataaaagggtggtttcaagccactacatttggaggtagtttttctaccccaatatataatcgaaacagccccaacccttattggtgcataactcttatctgcatttcctaactaggaaatatatttccaggggcttgccccacctctgaccacatgcagtgagaagagctctcatctccttttgtcagcatatgtggatttggctaggtgtatcaatattagggtcacctgcataaagtagaaaacacaagataacagcaactgaaacaagataattttttttcccctctcttgtaaaggaaatctgaggataggcaatgccagggctgctctggtaagtcctctagctttttgctctattttatatttggcttctaccctcaagatcacctcacttttcaggatggctgctggagctccagccattaggcctatattccaagtggtaagaaaaaggaatgacagaggactaaaaaaaagaatacctcccagcatcctttacataattttctctaaaggctcacttaataccttcactttggtcttattaaccaatatttattaatcacatggctgaatctaggttcaagggtcactgggagggacccctctgacactattggtgggaatgtaaattggtaaaccactatggagaacagtatggagcatccttgcaaaaccaaaaatagaactaccctatgatccagcagtcccactcctgggcataaatccatagaaaaccataatttgaaaagatacatgcacccctatgttcagaaccaagacatcagttcagttcaggtcagtcgctcagtcgtgtccgactctttgcgaccccatggactgcagcacgccaggcctccctgtccatcaccaactcccggagttcactatccaagatatgtaaacagcctaaatgtccatcaacagaggaatggataaagaagatgcactacctacatacaatgaaatattactcagccataaaaaagaatgaaatgatgccatttacagcaacacacatagacctagaaattatcacactaagtgaactaaggcagagaaaaatagcactcatatgctgaatctaattttaaaaatggtacaaatgaacttatttacaaaacagaaagagacttacaaaacaaacttatggttaccaaaggggaaacatacacacaccgctataatatataagttagataaccaacaaggacctactgtatagcacagggaactctatttaatattctgtgacaatctatatgagaaaagaatctgaaaaagaaaagaatatacatgtgtttgtataactgaatcagtttgctgtacacctgaaactaacacattgtaaatcaattatacactaaaataaatttttcaaaagaaatactggggaatgtgggcttcccgggtggtactagtggtaaaaaaagtctgcttgccaaggcaggagacctgagagatgtgggttcgatccctgggtgggaagatcctctagaggagggcatggcaacccactgcagtattcttgcctggagaatcccagggacagaggagcctgggtctttagtccttgaggtcacgaagagcgggtcacgcctaaagtgactggggaatgtactcgtatgtctcagcccatcgtgactcttcatgaaacctgatgctaaaggttctgatgctaaagaagaaagagaggcagtaggtgactaagcgaggatgaagttctgactgagcaggcacagcaagggagaggcagccttccaagctgaaggaagggagggtggctgcaggctgctatgtcccagacagcctcggacattagctgcgacctctctgctctcgccagccccacgggctcccaaagcctgctttgtagcctcctcctttctcagctctgctgcctggaacctcacaccaccccacctgccctcagggaaacagctgcagtctttcagggctcttgccccggtggggtcaggctccctcaagaggagaagggggcgacagaggatgagatggttggatggcatcactgattcaatgcacatgagtttgggtaaactccaggagttggtgatggacagggaggcctggcatgctgcagtccatggggtcccaaagagtcggacatgattgagtgactgaacaacaaaatcagcctctcagctgcactcagcagggagaggcggtcccagtcctgcagcttgagtttgataaaacttttctaggtcagcgttgggctccttgtgtcatactctgttgtgcctgtcttgtgaaaaccacagggtaggaccgcaactctggtgggattccccgcttaagcctttccccgcccattctcagtcatgtggggaagtggcctcctgggctgggcactaggacccagaagcctctttggacaggcccgcaggacagctgacctcccccactcccttaggtgttgagggatctcggtgggtggaaggggctgctggaaggagaagaaaggtggtcttcactgccagggccaccaggatggccccatgtcatggaacccaagttgtatgtgattaactctattttctttccttcttctaatgtaagtctggtttgcttttctgcttgcttagttgctcagccgtgtccgactctttgcaaccgcatggactgtagcccaccgggctcctctgtccatgggatttcccaggcaagaatactggagtgggttgtcatttccttctccagggatcttcctgacccagggactgaaactgcatctcctgtgtctcgtgcattgcaaggggactcttttacccgctgagccatcgaggaagctccaataagacagtagacagagctccagttcccttttgtctttaagttacctaatgtctatcacaatcaaatctgtcccctatctaataatctgagctctaataggcttctgtgtgtaccagggtagctgaaccaaatgtgctgtgattcatgggggccattgttcacctcacaaaataaaagacctacaaatacactacttgcatcttgcttttcttaccctgttagaatccctgaggcagaatcacagacttgagtcctatagcagttggtcacctgaaaaggtggggaaaaaattcagggagggatggttcttccagtggaggaaacagattattaccaaaggtggcaccctcatggagagaatgacctgggagcttgttgatctccagtggccttgtccgatctgcagtggcctcactcggcctgcagggacttggagcagggcctgggttcccagccagagattgaggccaggtcacagcagtgaaagcatcagctcctagccactagacgaggggtcagtgacaagtgtggcccttcagctttacagaaaaggatttccataaagacggaaagtagagaagaaagtatttattaagaggaaaagggtacaatatgagtggatagacacatgggcagaatcagagagcaagtgcctgagttgtaccctcatggcaatttaaatcacttaaaatggacatttcttccagttttcctttggccaatcattttgatttgcctggctcactgtccatatttggtatatctcaggatccttctgtggatgtgcatgcatctcttagcgtagatggatcctaccacaaaggcctgtgggtagcttagcatcactcccctttgacctccaagaagtctttctgcacatgtgtggtcagggaggtctcctgactctgataatgagaaatctgtggtctgggcagggcccagccatctcccttaattgtcctgctatttttgtcttggagtttcagtcctcagggaatgaagctccagttgcttcaaattgggggcggggggcacatctacctcctgtctcaaatccataaaggggaaggggcaggggcatggagctggggagagggctggaggcagccactggccagactgcgagctgttcaggaaaccaaggacagcaccatcttcatggacatgtctggccaccgatggcccacagaacagcccattttcctggagccgccaggaccatcgctttcccagggaaacagggccagacccccagggtggccaggaccactgggaaccatgacggccgctgcccagacatgaatggatggggaaggatcagccgggagaagaaagtcttttcctctttgctatgaattattccagggaaaccaagtgtctaagaatatcatctaatgtaagtgaaaacttggagtcagatgggtgggtggagggcgtgactgaacatgtctgctgagtggttgtggcccaccaggctcttctgagcttttcactcagacagcctcatttcatcccatagccctatgaggtcagtgagtattttttggtttgtttttggttctttaatttttactttattcggccgtgccgtgcgggatatgggatcttagttccccaaccagggattgaacctgcgccccctgctttggaagtgtgaagtcttcactgctggacctccagggcagtcctggtcggtggtgttattatgtttccttctttctcgggtggggaaactgcggtgtggagaagtgacttgctcccagctggtcctgcccacaggcagactcactctgccagtagcatctgccagccctggggacacagctggggctctgtgtcctgggcctgttcatagaaagaagcccaggaggaacctcattttctggaaatggcaccaaagtcaaagagaagagactgtccccggctccgtcctgcccacggcccctctgggcctccgtttttccatctgtgaagccaggggctgtgctgtgacctctttgggacctttctcccttacacatctctaatcagctcgctcacacagaaggacattaatgacggatgaggctccttgtgttttttttctataaacctttgcacttggctctatagctatttgagacgaatgaggaaataagaagctgggaagttattatttgggagatgagtacatggaggaccttcaggtaactccgtaataacctcatgcaggggaccacccagtttccttgtgtctaagatatccagagacgttaatgaggtttaaaatggtcagagggaggtcaccctcattaatagcaaagataaaatggctcaacaaatctctcagacatttggagtatgcttgaaaatagtgagcaagtgacatagtcattcaagtttccctgctttgggtcccaagatacaatcagaccatgtgtaacactgtagaactgtgtggaataatgttgaacagtctagaaccatctagaacagtgtgtgtatgctaagttgcttcagtcgtgtctgactctttgtgaccccatggactgtagcccgccaggatcctttgtccatgggcttctccaggtaagaatactggagtgggttgccatgtttgtctagaacagtggagagaactattctcggttttggccttggccttgccctgtaatcctgggactctcccggtccggtcagccttgatttcttcccctgccatattgaagcgatggtaacccactctgctgacctcatggagtgacgaccatgggaaacggaaacagaaacatttggtggcacctgcccccttgaaagagatgcgagttcactgaagcgcagcacagatccttgtgacacactgggctttctttgaggctaatggtttggaagtgaccctgatgctgggaaagattgaaggcaggaggagaaggggatggttggatggcatcactgactcaatggacatgagttcaggcaagctccaggagatggtgaagggcaaaaagcctggtgtgctgccatccgtggggtttcaaagagtcagacatgactgagcaactgagcgacagcaatgatttaatttgccagaatcttctcaatagaaatagactcttctcttgacatttcatctgttttcctctgacctaggagaaaggctcttgatgattgatgaagctgaggagctgacgggagtcactatagctggcttcttaattttttcttgctgacaaattctgacagtttataacctataggagaagaataaagtgataccttggggaaggaagacatatcttccacacagctctctcgctctgaaagaattctggataagatgaaaatgaagttgtattctaatttctgtaaaaacaatgtcctatccctgaatccaccttgcccactctttttgtgtccaagagcactaactagatgaaaagaacccttttcaaagtcagttctgtgttaatttgttatccaggatatacatgatcaatgttgatctttctggtgacttggagaggtagcaattttccagaagaaattaaagttaaggagtgggtgccaggtatacaacacgtaggtggtgctgggatttgaaccaggatatacctgactctaagacctcagctattccctatgctattaacttggcttcccaggtggctcagtggtaaagaatccacctgcaatgtataagatgtaggttcagtccctgggatgcagtccacggggttgcaagagagtcagacacgactcagcgactaaacagcaacgaagcagcagaaccttggagcaagaacttcaactctcagctgatggaggtgttagctctctcctggcaccttaattccacagctgtctagtttttggaagccttgtcctgttgctcattgataatgtgcctttctttagagatccagactcgactcctagactcccgagaccctctccccaaagaggatcattgtcctgccaagattgaccaggatggtgctccccaggctccagggcgctcaactgaagactgaagattggcatgaagccgcattgccattgttctgtggggccaccggaggagttgatgcccctccaccctgtcctctcacaagcggactgggctggcctttgaggccccggattgcaggcttcatcctaccaccactggctgggtcacctctggccatcacatctctgggattcactcacgtaggggttcaactctctcattaggacttttcaagttctaactccgaaattgtcatgttctagagagtcaggttccaccactttggcccctgtggaacagtagggaatgaaaacaggggtgcccttttctgttggaaactgatttatttcacaatcacactagcggtcactggggatacctggccagtcacctacctggtcagctctccattgtagctgttctttgacaactgaagggaaatgagagttttgtattttcacagtgtccataaactccagtatctcactcatcattctggaagtgagggttggaggaaatggtgctttattgttatgtcccttaaactgtgtgttatgattgaattgcatctgccaaaaaacgataaacggaagtcctaacccccaatacctcagaatgtgactctacctggagacagggtctttacagaggtctttcactgttaaccccatggactatagcccaccaggctcctctgtccatggaactctcccagcaagttaccagagtgggttgcccttcccttctccaagggatcttcccaacctagggatggaaccgaggtctcctgcattgcaagcagattcttaagcattttacagaggtaatcatgttgaaatagggtcattacaatgggctcagttccatatgacagtgtcctcatagaaagggggactcagagacagacaaacatagagggaagacgatgtgaagatacagggagaagacgaccatctccaatcagatgctcccacacagcctcagaaccctgcagacaccttggtctcagacctccagcctccaggcctgtgagaaagtaaatttctctgagttgtttaagccactcagtttggggttcttcactgtggcagccctaggaaaccgatgcacagtgtaagatggctttccagctgaaagaaactggacttggttctgagaagggggataagggcccagggtcacatgatggaaacaggagacaaacaccactgtggacccagggacattccggcttctgtccctcattgccgttttctacctttcccaaagagaaggtgagacctcggctgactttcctccacgtagtactgtcccctatccacattagtttgaagggatatatatattttttcgtctttgaagtgatatatatttttttttcttctttttttgaaccatagttggtttacagtattgtgttaatcaggtgtacagcaaattgattcagttacatattataatacattaggatatatatattcttttccattactgattattttaagctattgaacaccgttccctttggtatatagtacatccttattgcttatccatttaatatatagtagtgtggatctgtgaatccagtactcccaatttactcctcaccctcccttttcccctttgctaacagtaagtttgttttctgtatcagtgagtctatttctattttataaataagttcatttccattgttttttggactccacactaagtgatagcatgtcctatttgtctctctcagcccaactttcttcacttagtatgatcatctctaggtccaattttgtaatgatatttaaacatggttgttgtttagtcattcagtcgtatcctactggcatccctgtccttcaccatctcccagagcctgctcaaactcatgcccactgagtcaatgatgccatccaaccgtctcattctctgttgcccccttctcctcatgccttcaacgtttcccaacatcagggtcttttcaaatgaatcagctctttgcatcaggtggccaaagcactggagtttcagcttcagcatcagtccttccaatgaatattcaggactgatttcctttaggatggactggttggatctccttgtagtccaagagactctcaagagtcttctccaacaccacagttcaaaagcatcaattcttcagcactcagccttatttatggtcatactctcatatccatacctgactactggagaagccatagctttgactagatggacctttgttggcaaagtaatgtctctgctttttaattcgatgcaaaatcactgcagatggtgactgcagccatgaaattaaaagacgcttactccttggaaggaaagttatgaccaacctagatagcatattcaaaagcagagacattactctgccaacaaaggtctgtctagtcaaggctatggttttccctgtggtcatatatggatgtgagagttggactgtgaagaaggctgagcgccaaagaattgatgcttttgaactgtggtgttggagaagactcttgagagtcccttggactgcaaggagatccaaccagtccattctgaaggagatcagccctgggatttctttggaaggaatgatgctcaagctgaaactcatttggccacctcattcgaagagttgactcactgaaaaagactctgatgttgagagggattgggggcaggaggagaaggggacgacagaggatgagatggctggatggcatcactgactcgatggacgtgagtctaagtgaactctgggagttggtgatggacagggaggcctggcgtgctgcgattcatggggtcgcaaagagtcagacacgactgagcgactgaactgaactgactgaagaacttaagttgctttaaaattcgccaagtctaggtgagctcagacttgctggttccccgtggagtggcctttgcagctggaactgccccctggtggatctgctttttcacatttgacttgaacgatgtttgcacatcgttcattgtgtggaaaaccatggcacacccagacccacccagtttcccaggagctgagaggctgctctgggtctggcagtggcaggtgacagtcctgaccggtccaggagccaatgagaagttcattttaaaattcgccaagtctaggtgagctcagacttgctggttccccgtggagtggccttgcagctgcctcctggtggatctgctttttcacatttgacttgaaaaatgaacgacgtttgcacatcgttcattgtgtggaaaaccacggtgcgtctggcacggcacacccagacccttttcccaggagcggagaggcagctctgggtctggcagttgcaggggacagtcctgaccggtccgggagccgatgagaagttcataggctgttaataaactggaaccaatcggtgaatgcgggccaggcgtgcgggggccggctgggcccgcgggtccttgggagagctcgcacttgtgctgcctttatctgcatatcgcaggagcctggaagcgcccggccgttctcagcgtttgttacagtgaatagacatatgcccctcacaccagcacagggaatatctaattaagctacacaatgattgcttatgcccggggctgtcacaaacaaggctctgtcactctccgctgagaaccacaaaatgggaatttgctttcagggcacggtaatgaatatattcgacatatattagaattgatttagatcccacaccccttaaagaaacacagcaaatgccattttcacaggaatagtttagagcccatttaaatatttatttttaaatattttaactcctattttaactgggaatagggtcgtgggctgggggggtgggcagggtagaaagctcctggtatatattggttggttaattacaatgttcagtgtaacttgcaatgattgtttttcatgaataagttaggaccgtaagggtgggagttgtattttgctcagtattaacagaaatgtttgcatgtgttccatgagagccaaaatctttgagcttaagaagggaatatgtttttcttaagttggtcttcccttccattactttagtatatgtgggacccacaaggaaattttcctttctttaaagtcaaatcattttagtacctcaaactgaagtcctatatcccttacttaggacttgtgttgctactttaaaatggactgtaatttttaacagggaaaaaagcccttgtcttggttttgttgctgctgtttagtcgtgtctgactctttgtggccccatggactgtagcccaccaggctcctctgtccatgggattttccaggcaagaatattggactgggttgctgtttcctcctccaggggatcttcccaacccagggatggaacccatgtctcctgcattggcaggtggattctttactgctgagccacctaggaagccccttatcttggttttggacctaagaaattacctttccttctactgtcatggccaagaaggaactcagatggaagtggggacactgtaagaagttccttggctggagtaggagaaactgtgaaaaccacgtcaaagagtttttcatcaagagaaagactggctacctaagttgcagggcccagtacaaaatgaaaatatgggttccctcatttaaaaatcattattagggatttctgggtgacagcagaacattaaaccaaccacagagctctactgagcaccagaacttgggtgagtgactgcaggggtcccacacccatgaaactggccctgccaaggacgcttttattcctctataaggaaaagaggaaaagaggacaaggaaagaagaggtgatgttaaatccaaattttatacagcccatgagtccagagatactcagtcaagatgaaatgaagtgaaaaactatttcaaatttattttgttcatcctggccaggtgaacttgaagagaacatgcatgctcagttattcagtcatgtccgactttttttggaccccacggattggagtcttccaggctcctctgtccatggaattctccaggcaagagtattggagtgggttgccgtttccttctccaagggaccctaccaacccagggatcgaactcgagtctcctgcattggcaggtagattctttaccactgatccacctgggaagcccgtttaaagagcagagcaggcctccaacactagcagttgggttctaaaggcgtttttgtgcttttgtctttccaagtgtaaagctgcttttttctttcccttttcattcatgattctatcagttcagagaatgagctctgtaaagaattatgcgtttgatgaatcggtcagaattctggagagaaagcagagatggaaaattcctgccttccctagaaaaatgagaaatagaagccttgagtagcattctcccagttgctgagagccctggctgccgttgggttttgcccggtggagcaggtggggtgtggcgacttgtggcttgtctgtccctcatttgctgtgtccctacaacccaaaacagatgaagatgcctcctcatccttggaccctggtctgcccccacacccaccatgagtttctcctgcagggccagggtcccatctggtcctgcccatgaaccactgtccatggggaaatagctggttttcctcagaggaggatattgcaagagatctgtcaggctttctttttaaattgtgctaaaaaacaccaaacataagatctaaaccacttttaggtgtacagttcagtggtgttaatgatatatatatatatatatatatatatatatatatatatatatatattgttgtacaactgattgccggaacagttttgtgcctgttcagcaaaggcgaagggagaagcaggcagcagaggatgagacatcgatgactcagtggacttgaatctgagcaaactccaggagatagtgaaggacagggaagcctggcatgctgcagtctgtggggttgcaaagagttgaatgcaacctggcgactgaaccacagcagcaacacaactccacagtcatggtttcgggcatctgaaaaggaaagatcgtcaaactcaggaggtccttaataaacatccttaaatgaatgggaccacactaagctgtgcaactaagactttgtgtatgacccgaccaagtccctgggccccatacaaattttgtgacatgatttttgctgtctcctgataactatccacttaccaaaaaaaaaggtgtgtgtgtgtgtggtggggtggtggtggggggagacttttgaatcacttggattctttgatccatttcttctttttttttttgaacccatgccccctacagtgagagtatagtcttaaccactggaccaccagggaagggcaactctggatttgattgctaaataatctctaagccttcatattgaacagcgtctttgcaacctctcagctatcccagagcttagttcggtgtctgatatacagcaggtgcttcgtaaatatttggtgaacaaatgagtcactgaaaggcttttcagtattaatgaggagggggaaaaataaatgaaatcatgtaatccctaaaccccacttatgccggtggcctcagccccctgccagagagcatccttcaaagcaaagttgatggggtgtcggggcagggtgcagaggacagggaggggagggccgggggtgtgcacacggccaggtagccagaaacccctggcctgggaggatccacctttggaaggagagctaaaagactctcttgggaaacagaaaaacccggggaggactgaggtggagggtggggcatccagcaaaaatgtcagagtggtttaaaagcagctgagggttgatctgagtgctgcccgctagggtgctagatgaggaagatggttgggcaacaggtcgggcagggctggcaggagctgcaaagcctcatgggaggaagtgttgcaggaggacagaacctgacagtggtctggcttagggattcaaagacatctggaaggaaatctggaggtggggtcagatggtaaattatgagagaaatggggagatgcaccattatttaagaacatgaacctatttgttttgtctaagacagagcaggacttgcatgctcattcacatccttttttaaaaatgagaaaagagcctaaaagcctttgcaaggaatgtccaggatgagtctggggggaatgaggtttgggctgaggggttagggagtgtgcgtacttactcagagatggtatgtctgcagctggggaagcgtctgagattgaggtcaaaggcaaagcaaaaaagcaaaaaaaaaaggcaacatcaccaattttgtttttaccctcccccagctctctagggacaagtggtccaattccaaaggtggatcaagaagctgcttctttttcctccaggtgagggggttgttagcgaagaagcaactgcaaggtacggaagcttcaatacacagaccctctggcacccagtgaggagtcaggacctggcccagaagatgttagggtcacacttgcttgccactgtcatggggttttcaagcatggcactagggcagaagggctaggggagaatgcttgggaattcacctgttaaagcaattcactctgggtcctgtgggccaattccctcctttgtctgggcctcagtttcttgtctttgaggtgggctcattggaatagctcattgagtcagaatcacctggtgattacaaacacacacatccctggcccccgcccccaaagatgctgactcagtaggtttggggtcaaagcctgctgtggatgttgcgtgcgtgcctgctaagtcacttcagtcatagccgactctttgccaccctatgaactgtagcccaccagcctcctctgtccatgggattcttcaggcaggagtactggagtggttcgccatgccctcctccatgagatcttcctgactcagggatggaacttgcccctcttgtattgcaggcagagtctttaccgcttagacactggggaagcccacagtggatgttttaagaatgaacaaacaaaacacccacttggttttactcattactacaagttgatgtctctctctcacagttggaaggatgccaaagttctcttggcagaataaaccccagggtggactaagttttaacatcccccaaccccatgctcaagttggatccatctttcagggccagtttaagtgcgctgtccttcctgaagtcttccccacctttcagatccctggtctgttcttgctttctccacctcctcaatcaccgtgatgcatcagtggaacaacatgactcggtgcaatggcacagcccgttctccctctagctggccttcccggaagggcgtgctccttgttgggcgatccttgtctcccagccgccctgacaccatggttactgacttcagctggaccactctctgatgtgtcggctgggtcagcgagccatcacagcacagctaatcatcactttgcttattgtcagttcagctaagttagcatctgctctttgatctttccagtggggtgtgttcgaatttattcattttagtcaccttcatgcaaatctcctgtacatttattccttgtgatttccattagcctaaagggttaggtttgttccacagcttgttaaatttctccagtgatatgtgttcttggcacctctctgccctgatttggaaaaaattgtgacatccattctcctggtaagagtcatgcttttctcacccattgttaagtagactcttccgtctcagaaaaaaaagaaaaaggaatgaatactccaaattaggaacttacatacggagaaaagcagagatagagttgggagtgttgggggtgaggggaggaatcgagggcgggggctgggggcagagcagcgccacatgccagatggagaaagtctgcttccagcgtatcgtgtttccttgtttttcagtctcctgatctctctcctcttctccaatatcgtttcatggtcctttaaaaaaatcacagtaatgccagtattaatgttgacgtggtggggacaggtggaagcctacttaagaggtgtgcagagagacctaagctgcatggcctcttgaacatgcctaaatccagtgcttgttccttattttctggcagaaatcgttctgaactcctcagtgattcagctaggtgtgctggtggtgcctttaagtaaaggttccttatccagtgattctgataaagtggagtctggaggtttatggcgcagatttgatgtaaaagcaaccaggctccctctaattacagaagtgaggctttgctggcatctgaaataggcgtgattcttctgcggcatctagacggatccacacatagactcctatctctgttttctcctctcgcatttcccctggtaaactcttcatcactcagcagcataagtcacaatggaaattggacttctgctaagaagattttaagagggaggttctctttgggtttgacttgcacacactgcattatagcacagggagctcaggctggtgctctgtgatgacctagaagggtgcgggaaggccaagagggagggaacataggtacacatatgactgatgcacttcgttatacagcaaaaaccaacacaacattgtaaagcaaccatcagtgcgttagtctctcagtcatgtccaactctttgcgaccccacggactgtagccctccaggcttctctatctccaggcaagaatactggaatggttgcccttcccttctccaggggatcttcccgacccagggattgaacctgggtctcccgcattgcagacagattctttaccatctgagccaccacagaagccccaaagcagctatcagttcaattcagttcaactgctcagccatgtctgactctttgtgaccccatggttgcaaaaatatcccaatttaaaaaatgggaaaccaacaaggttttagaacagggaatatcactcaatactctgtaataacctaaatgggaaaagaatttgaaaaagaatcatacatgtatctgtataactgaatctctttgctgtaccacttaaaccatcacaacattgttaatcaaccgtactcctatgaaataagttgttttttaaaaaagaggaagagtctatcgtcactttgcaaaacaggtccttccctgctctgagcagtccttatggcacttcttcttccctgcatccttttattttccaggggaattgttatctgttgtgctctagttatgtggtcccttaggatggttcagtcctttcccttctcactgattctaatacttcctcccagcgtaccatgctcacccgatttccccttaatctcataaatctccttccaccaaaacttaatccagagatcattagctttctctgtgtccatttttcacaacagtggattttttgtatcacacgttctataggagcagtatctagaatttcattgagcgagtcttttttcaacactcttaaatataaagacaaactcaatgcaatgtggtatcatggattgtataccctccactcttctctggaaccaacaagagatgctaatggaaaaactggtaaaatctaaccagaatctgtagttcagctaatatcagggtaacagtgttaatctcgtagttgtgccaagtgctccaaggttatgtcagatattctaggggaagctgccagaagggtatatgggggtcccctgtgctacatcatggcggcttcccagctgcctcggtcggtaaagaatcctcctgcagtgcaggagacccaggttcgatccctgcatcgggaagatgccctggagaaggaatagcaactccagtattcttgcctggagaatcccacagccagaggagcctggaagacaacagtagtgtgtggggtcgcagagattggacacaactgaaagactaagcctttcgcttccttcacttcatatcatggcaatgtctctgtgacataaaacacattccaaagtgaaaagttaatttgaaaacggacaattttaaatatggtgagaaaaaagagagaaaagaaacaacaggaaagcgaaagacttagcacacgtgcatagttgctttgaaacgctgtgttagtttctgctgtacaacgaagtggaccagctatacgcatacccgtgtcccttcccttaggacctccctcccgtatccccccaccccacccctctaggtcatcacagagccctgagctgagctccctgtgccatacagcagcctcctgctggctgtccatgtcactcgaggtcgtgtatatacggcagtgctgctctctcaatgcgccccgccctctcctttccgcttcccgtgtcctccacgtgtgtctgtgtctctattcctgccctgcaaataggttcatctgactgacctctgctcacagcttgccctgtcttctctccaggcaatgggtgtttttatagggcttcccagagacaccacacttttccagacattggcagtagcaggaggaatgctgagcgccaccggaagctggtggggagagactggggtgcttgccagctccctgggtctccccccatgaacacaatgaagagtagaccaattttgaaggccaaaaggcaagggtaagcctgcctttctctttcagagagtcagaggagagcagtttggagtcctttctggctctttctgtccctgtgggtgcttctctgcccctgtgtagagctggggtgaatctgaggtactgcctccatgggctgctttcaggcttcccagatggtttagtgataaagaacccacctgccaatgccagagacataagagatgtgggttcaatccctgggtcaggaagatccctgggagaaggaaatggcaacccacaccagtattctagcctggagaatcccatggacagaggagcttagtgggctacagtctatggggtcgcaaagagttgaacatgactgaagccttcatcatgggaggcttggcccagggtgagtcctggtgcccagccctggggacacgggcaggagagggggtgcagtgctggctcgactgctcggcctggcttcacggacggggagacaaaaacagtcaatgagggtcctacctcctctcctggaaaccgtgagcctcaagatgaaggcgcagcccaaactgctcaagccttcacttcaaggtgaggatggaaagagtgaacatggtggcttctgtgggtttccttctcaatgatagagaggcaggcatggaattagaggaggccaggtgcaccccacttagctatgtttccagagggatttctttggactcttctgtgtagttgcaagaaaagtgaaagtgttagttgctcagtcatgtctgactctttgcaaccccatggactgtcgcatatcaggttcttctgtccatggaattctccaggcaagagtactggagtgggttgccattcccttctccagagggtcttcccaacccagggattgaacccaggtctcctgtattgcaggcagattcttcaccatctgagccaccagggaagcccagttgcaagaaagctgggttttgtctgctgaatttgaagctccaacactttggccacctgatgcgaagaactgactcattggaaaagaccctgatgctgggaaacattgaaggcaggaggagaagggggagacagaggatgaaatagttggatgcatcaccgactcaatggacatgggtttgagcaagctccgggagttggtgatggatagggaggcctggagtgctgcagtccatggggttgcaaagagtcggaaacaactgagcaactgaactggcttttgtttttgttttagaaagtaggttactctctctcctcagtggttcactgggatgtggggaaggagacttctcagagggaaggggagaaaaattagaactatacctcaaatgccaaatcctggatgtagaagaggagaaatgtgagcagtacccatgagctaacgcgttggaacaatacagcatgtgtctcccttcttctgactgtcaatcatatgaaaatacttttccaatctacaacacggttcacacaaaccaacaacaccccgccccccaacaatgattcctttgcacctttgccctcccatcgagccctgcattgcagaaggggcccagcctggctcctttagacagccatcatctctccaaagaggagcggtgttttgtaaccggacagaactgggaagcaggctctgggcgcggcgtcctgacccgggcaggcgccgcccgggtgcgctcacagccatctgctgcggcctgtaatgtatgagcacattagcacacggcccgccagcagactggacattgttctccgggcgagttggttcagccaacctcaacaaagaggccggtttttgcattcgggataaatacaaccactgagaagttttgttttgttttgttttccccccttgggacatgtaatgtgaaggtttacactgactgaattgaaaagctgcggccacccctcccacccttggatgtggatggtttcgagagctgctaaggtaccaggaaatctttttcctctttcagatatgctcccactggacagatacatcaaactgaatttttggcctttttttcacttctttttaacccaaggagtttgtctcccaaaagattaggaccaactgtttgactatgaatccacttaatttaaaggtcagtctgaggcttcagggctggtaaagaatctgcctgcaatgcaggagaccccggtttgattcctgggtcaggaagatttcctggagaagggataggctacccactccagtattcaagggcttccctggtggctcagctggtaaagaatctgctcgcaatgcagctgcaatggattcgatccctgggttgggaagttcccctggaggaggaaatggcaacccactccagtattcttgcctggagaatccctgtggacagaggagcctgggaggctacagccggacatggggtcgcaaagggtcggacacgactgagccactgagcacagcacagatgaggcctcaccgtctggatcctaattatgctcaaaaactaaccaaaggactcaatgaagaagtggagaacggtacagtgttagtaagtttgttaagtgttacagctttagtaagtatgtaagatgttatagctttatttgttgatcctgactaacaggttacttcaggaaactcctaatttacctctcatctcaagtccaatccaagaccagcctccaggacttggttgatgttttaaaaaacactttggggactgcagagctcaaccatgcacttttcacagcatcaggttctgctggtgttttcttgtgtgggagtcccagtgaagtttctgctctagttaggaaagggcttggtggcaaaaatcctctgtgtgtatccattccatgcattcactcattcattcattcaaccactgttcattgacctcttaccatgtgctgggcactgttctatatcagtgatcaggatggaaaacatccttgccttgtggagcttatattctgctggggaagacagacaataaacaacaaaactaagaaatttttaaaaatatagcaagaaggaaagaaaagtgagccaagtaaggggattgaaagtgcccagggaaggctggagtattaaaaaggagggaggtgatattactatctcaatggacagcgcttccatattcccaagagaatgtacaacatccttggataatggtacctcccctacattatagccccctgctcctccaagttcaattctaattagaaaaagtcagttgaccaaccaattggaatcagttgactccaattaagtaggtttcaaagctctgaaatgctaagaaagaccatgtttcttaacttttgtttccatatatttccaacttacccaaagcaggagatgggatgaagggtagtgaatgtgtgttgaatgaaagatggggattacaggagtcaggatatcaatttgtacactcccccaatttatgttgaatcctgatgatctagttcaatgtccacttcttaaaatgtgactcttatctatatcacaacgaggtcctgtacatgcgacaagtaagctggccatctcatcaccaagtcacagattgcactgggtgacttgacacatgcaacaggatggataaacctcaaagtcattgtgctgagtgaaaaacaaaactgatgcaaaagcgacatattgcatgtttccatttatatgaaacgtcctgagtaggtaaactgatgagagtctggctggatgtttaataagggaataactcacaaaatactgcccacttcagtgttcagccaggcttctcagtaagatttggcctctctaagacccaaaggtacagacttgttagagggacctgatccactggaggtgcctgtcaagtcccagggctttcttttgaatggggtccttgacacagggttgtggctggcaggaaagacatggggcttctttctacaactggcagggagaatgtcagagttgtggaaagtcacagaggaccttaacttggaatgggccttgccaaacttttcaatttctgttatgtaatagatgagtagattgaagcccagaaagatcaagcaacttgccttagggcacccagcctgctctagatttttaactcctagcccaggtttcttttcaccatggaaggtcacatgcagtgacctgggcattactcaggagtaagtgagactattaacagatgaatgaaaaagaaagaaaagtgaaagtgaagtcactcagtcctgtccaactctttgcaaccccatggactatagcccaccagtctcctccatccatgggattttccaggcaagaatactggagggggttgccattttcttctccaggagatcttccccacccagggattcaacccaggtctcccgcattgtaggcagacactttactgtctgagccaccagggaaggtctgacagatgaatggataagcaaaatgcagtacatctatacaatggaatattgtcgttgtttagttgccaaatcatgttagattcttttgcaaccccttggactgtggcctgccaggctcttctgtccacgggatttcccaggcaagaatactggagtaggctgccatttccttctccaggggacctttccaacccggggattgaacccatgtctcctgcaatggcaggcggttctttactgctgagccaccagggaagctcacaatggaatattattcaactttgaaaaggagtgaagcacatgcaatgcgatggataaacctcaaaatcattatgctgagtgaaaaacaaaacagatgcaaaagcgacatgttgcatgtttccatttatatgaaatgtcctgagtaggtaaatccatagagacagaaagcagattagtggttaccagaggctggagggaaaggaagtggttaatgagcaggatttcactctggcggtgataaaaaaaaaaaaaaaaatgttttggcactggagagaagtggtgagtgtataacattgtaatgcccctgaattgttcagatgaaaatggctcatttcatgttatggaaatttcacttcaattaaaacaaaccaaaagaagtgactgaaaccaacaaggacctgctgtatagcccagggaactcaatatcttgtgataagctataatggaaaaggatctaaaaaagaatatatatatatatatatatgtaactgaatcactttgctgtacatttggaactaatacattgtaaatcaattatctctcaataaaaaaaattttaattaaaaaaaaaaaagaagtatctgggtaagaggaactgatggcttaaacaccaaacatggggtaaagacaaccagatctgcctgtgggtgggaggggcctgatggaagagagactggaagggagaggggtggaggtctcttccaggcttttttggttcaacagttctctgagtttcctgcccctgctgcaacttataccagcgtctgggctgcactagatcacttccttcctctctggctgagccacacaggtctcgggtgtcttcactagctgaaccggcttgaatagcagggcgagctcagaagcagggtgatggggagctcctcgtcccattctccagaggggccaccacagctctccctgtggctcccagccgcaatcctagagaggggagatcctccactgtccagctgaccacttgcactgggcatcccaggggcatggatagaggccaggcggtggggtcagagaacttcgagggtggggcctcagcttcacaggtaaatttcccttcagttagtcctccttgatcctagctcctgcccttgtgaaagtcactcagtcgtgtcccactctttgtaaccccatgaaccatacagtccatggaattctccaggccagaatactggagtgggtagcctttcccgtctccaggggatcttcccgacccagggatcgaatccagggatctcacccaggtctgccgcccttacaaggactctattctggtttctgggcatcccaggggacactagtggtaaagaacctgcctgtcaatgtaggagacgtaagagacatgggttcgatcttggaggagggcgtggcaaccaacttcagtattcttgcctgggaagtcccacggacagaggagcctgctgggctacagtccatagcgtcacacaaagccagacataacctgaagtgacttagcacacacgcacattctgttttctatgcagcatgtaggccctgctccagtgcaaggcaattagacaatgcaaggacagcataacaggcctgtaacacccaccctgggacatgcagaggtgaggcaaggctctttgccctgcatagggcaggggtgactagagtctgtatatcacgctcaggggacttctgggcctctcctggggtcctgggtcaaacaggcccccttcagatgctgcagggcaggtcatgtgacagagtaacagggaccctacctcacaggacctcccagaagattcagtgagatgacaccccaccaggtgggtagactcttctgtttattggacctgccctgtatgccaggcccagggcccatttgtccctttcaatcctgacgccctgtggaaatggtattagtaccacacccattttagagataagcaagctgagattcaaaaagcccaggcctctcttccaggtcacacagctggtggagccaaggcagcataccatggccccacacctaactgcccaaacatggtcttcatggtgctcgatcaacacccccgcaacccccacccactcctgcctgtcccaacacatgacctacatattggtggctgcatcctgggggcccaggctcacaagtgagggtgcagaagtggcattctggccagacgcctgggctcagggcatccattcacagctagaaccaggcaggaagccatttcgtttattcttggcagtaacacagttgtgaggtgctactattaactattctatttacataaaaagagacaggcacgctgggaggtctgatagcctagctctctgtcaaatgggaggtctgtctgggtagaatcaaagttgccctccagcccctgggtcccagtggcacgtatccgcgcatgatttcctggcctctcacactcgtgtttcccccacactctggaaacctcttccttccctgagtcctccatttaccatccacagtcattcatttacatcaagcaggcaggtccagatagaagtctagatacaaaggtatctaagccagtttctacctggggagccaaaaagtcaaggccaaatagcagttgtttctagaattgtctacactcccatttcagtggaggctgtgaatttcattagcccctatatgcttgtgtgctcggtctgactctaggccacccccacagactgtagcccaccaggctcctctgtccatgggattctccaggcaaggatactggagtgggttgccatttcctcctccaggaaatcttccccacgcaggcatcaaacctgcatctcttgagtctcctgcattggcaggcaggttctttaccactgcaccatatgggaatcactggtccctgcctacacaggacgctaaggggaactgttttcacccatcacactctccttcccagccaggggctccaggaacctatgcccagacgtggaccagggcacccagagcctagcctcatcctcccacagagctttggtgatcacccaacctggctccattttacaggtgaggaaactgaggccagaggaaactcaggccccactgagcttctgaggggccactccagctctgctcttcaaggccagcctctactgcccagagatctgaggatgaagagggagccagtggctcatggtcctgttcttccacgggctctcgctggagatccaagactttagcctggaaagctgagggctcagagagcgggtttggactggggggttcgcagagggaagattagtgggccagcccacaaggcctagaaggaccagggagaggacagattcccaggctcccgaggatagtcgaggaaggggaagataaaccgagctgtccccggccaaccgtcgctgtctcacggggcctcaaggacttccagaccaaggccaaggcttcgaggttccagactcgccagtgtgcctgtgacccccccacccctcccaccccccccacccctcccaccccccccacccctcccacccacccccaccccgggacgtgcgttggggtgcctgagtccttgtgcgtaagcgcgggtcaggaggtcagggatggtatttggtctccacatgaactcaggcgcttctggagaaatccgcttgtttccctctcagggaggggtggaggggggtactctcaatccctcccacagctagtggactcagaggccctgcgaccgccggactcaaagctctccaaaggaaagccgcgcgccgcgtcaggcagctgcttcaacccgagccggagcgggacgagctggggctccggcaggcgggcggaggggcgtgcctgcgaggccggggcccccctggctgcgttccgcctgctcgcgatccgggaagccaggggaccgcggcgcacagctaggcacgagatcacgcaggaactctgttcccagaggcttcgaggcccgaggaccccagcagatccaacgacccgaatctgccgtcctgatcatccgcatcactttcagaggttgcagactggaagcccgctggccaattcgtgccacacacccgccatccccggtgtcgggggcgggaggggggccttagtgtgtgataaaaagggacccgaggtcccttggaaagacactgcgctctcccagcttgcgcgcccccgtcgtttgcacggaccgcgcgcgtgtcctgcggcccctgcaggcatttcagtttgcgattcctttccaagttgttggggcacgcggtgtggaccgcgccactgggcaggagatgcgggcggcgggcaggcggcgggcggcagctgtcccgcctcgaacgccagccagtccacctcagcgtcgccggccgcctcattagcggccgcccgcgccgcgcgcacccacccgagtcggctaattgctaaagcctttgggcaccgcccgctgcccagatgggggcgtcggggccagatggggtccaggcgcacagggagagccctaggagtgtcacctaagggggctggggactggggcctgggtggtggtgggggtggtggtgagcagcagtgtgggagctccaaggattccccaagaggtcagaatctagagactagattggcgaggaggagagatggctagggcagcctgggtatggatggggcgacttcctcaaggtggtatctggagccagaccccccggatcacaacgttgctgcttccatttactgtgtcttcccctgagcaaaccatttaccctcgctgagcctcaatttcctcacctgtaaaataataattaaacaaatataataataaacagtagcaccatcctcaaagggttaccaggagaattgaatgaataacaaccacagctctcagggtgatgccctatacggactgctgctgctgctgctgctgctaagtcgcttcagtcgtgtctgactctgtgcgaccccatagatggcaagccactaggctcctctgtccctgggattctccaggcaagaatactggagtgggttgccatttccctctccaatgtgtgaaagtgaagtcactcagtcatgcccgactctcagctaccccatggactggagcctaccaggtcttccatccatgggattttccaggcaagagtactggagaatcccatggatggaggagcctggtatacggactagccttctgtaaatgttggtgcctcctcttccagcctcttccgcctattattggcatcctgaacttccagggtgcagctgggcaccgcctccaggctcccagatctgccacaactgttggccactgcacaatgcatgtggccctgtagcaacaaggcagcccctgaggtaggaggaagtgatgaggggtgagccccgtctccaccctgctggcccattactctgaccaggaatggagggtttaaccccaggggttgcactgcctgccccctccaaactgagccacgggatgctgacccatactattccacagccacctctccccagccagggtaggactcactgtagcaaccacttaccctgagaacagccaggcctgattctggcctcccttgaaggtgtgcagagacttagggggcctgtcaagagactttgggtgtagggctgatgtcagagacccccaagagtcttactggcactgtgaggcccttgtgtggaggcccagatttggcctgaagtctgtactaaaagaggaacttaaaatgagaggaaggcctatatagcgggtattttttgcctttgatgaacttctagggggcatcaaggtatttacttgatagaaggagttcagactcgttgttagctgggttctatcctagggatagcagacagatggctctccagtctgagagtgtctagggggcttttaaaatccaatgtcctggcctgggagctcctccccttctcctgccttcccatctgggatggaggaggatgggtcatgcttgctgggttgccccagccccagcctgcatgcatttccctggtacttaagtcttcctccagccatccttgctgagatctcaggaacacattctccagttgagatgccctttagatgtgagggtttgctttgccccttggctcacttccagttgccagaattcagagtttcaactttatgggcgctggaggcatgggataccccccccacaggggttcccatgtgctccccaacacaggatcaaaccagggattcctcatttctctgtctcctgcccagtaagtgagaggggagggaggaccgtgccctggagggcagagaccacgcaggaggccccctaaacctcaaatcagtccgtttttaggcaggggagagggtgggggagaatctggaagaccttgggagctggtgacggaagtctctgggtgcccaggctgagagctgagacacttccagggccatgtgcggggatagggaagctgagctgtggaccagggtcctagagaacctaatgaagggaagggggtcctaggagccagtgccccgaggaccgagtcactgcccagtgtccaactgttaggataccgccttctccctgcctgcctctctcagtgtataggggcggtttggggggtgggatggggggagggtggcccggagattgtccctggacatcagcgtgggagtttaacttcctttctctctctactccgaagcccaaccgctgacctgagtccgtcacccaggcctcccgccacgccagggacagtctctgcaaggagccatctgcccggagtggtcctgccggccagtgtgcgcctcctgcgcctcgtcagagcgctcggctctcacacgtggtggcccggatccctggctggtgcaaagtttaggcagatggctctggggagcgcccggagcctggctggattcaggccctccttcctgggggcccgaggtctagtctgactggtggctggacacgaaccgagagcttggacatgggggatgggaagggggggtgacttgatttctttcaacaactgcccctctacggatacattgctccctcgggcagccccgcctgcacctgccaagccttggggtgggtgtaggaagctgagactgccactgcgacagggacgcccccccaccttcaacccaatctgcatcgtggggtcctctgtgtggcttgtcggctggagaaggacccagttttaaatccttgacaaatttcgtttcaactgggatttgaaagcaaaacctattagattctgccctaccctctttgtggattcctgtggagcggtttgggccggacccctttattccgccctctgcagccccccggccttcatcccagccgagggtgagaagcgaagcccagtacgaggcatctgatcctggggggcgccggctgttttaggccagtggcctgacagtatctgctggcggacccagaaactgcgtgtccaggagcgaggagatggaaccaacctccgtctcctgaacgcccagtcttcgtgggcccggctcaggggcgatccggggcgatctcaagaaacggggcgggggaggggttccaaccagggaaacctccgccccaggtgctctgggcgctgggaccttccaccggtggccaccaaaggtatcgtgagcgagcgcgcccagggcgatggaccatccaccacgtccgcacttcgcagcgttccggatgcgcgctctgctgtgagccgcaggactggaaggcggcaaaacgttctctcctcttccttgatcgggaaaggccgaagcttctttaccttttacccccaaatctctcttaagagccacgtcctaaatttgccttgcaattttggattatgaggaacccgatagcagcgagaaaacagaggcgggagtcaggattaggaagccctagaccaaagcgcggctggcgacagcctcgctcctggcaggcagttcccagcacctgactttttgcggttcaaggccggcgagggagccgggcgagggtcgtgcgtagagcagggaagggagcgaagggttagtggaacccgcgccacaagcgcccgcagccctctggcgggaaccacatggcgatgccgggccgaggggacctcgcgtcgctcgtccgcagacggatgcgggtggacgaccgcccctcagcagagagaaaatggaatcgcttcaggacacggggacctaagcgcccggactcccagccagagacacgggtctcacccgggaggcccaaagttcgggcctccgaactttgcacggaggaaaaaattttcactttcaatgaatctaattctcaacccaatagaaaaggagttacgggttaggcgtcagaaaataaaaataaaaacaggtgaggaggagcacgccgaggaggtgctcagaacgtgttttaaagagaatgtttgttacgggggagaaaaatgggccaacaaccctctcaatctttctctaggacaaaaccagcggagcggtccccaaatccagcccagaaggatggagtccggccgcccgcttttcccaggcggctccccgcacctccttccacccacaaggctggaaaacacccgacttactctaaattttatttaaaatctcaacactcggtcatttatttcatttttttgcaaccaaacaagtaataaatattatttagcacttttatctttttacaaaaataaaacagatgatacactctctgcaaggggcagcaatcggagaggggatgttacgtggccgacgctgtgaagcccatattgcaactctgcaagccgaggcggttcgcgcggagggaggaagcacgtggaaagagtttgtcatttgtgttaagctggcaaaaagaaaccaatatggaagaaacccggcttagactggggaggaggtgggaaagtggcagtcacgtgagcaatcagcttagcagcacgcacttacctcattattgatctatttacacatcccaaagagaaaaaaaaaaaaaaactaaaaagtcaacagaactcccaaataacccaaactatattcacagcaacatcctttgagttctgtcaaatcttcgggtacccaaacgactgtccccagccaggtaagaaaccaaatcactttgtgctcagagacggaaaaagggggtagggagggaaattctattttaaaataactaaaaaaacccacccgcacccaaagtcgacagttgtaggttataacaatccacaagtggttctattctgactgtctataaagcttgatcgcactgttgaaaaaggaacgtcgacagattccttcgaaatccacaaacccaaaccaatcagaagcgacagggagaaacagcccgagaccgctgtgggtttatccagatacagagactggacgcgaccgtaagtgcttctggtgccgaatactaactcgtagcccgagctctgggcaggggaggacctttgagggcgagtccggacggccgcttctggactgcggctccagagtctcctacccgcccggagaggcgaggaagtccccaacgctcccctcctttccttcctcctcggtactacgaagtgctgcccgggccgagtgaggccgagttcgtagggaaagcagtttttagaatcacctcttctctggggttctgacggggggcggggaggggagggagggttgaaagacgagatgcgggtagctgcgccttcttataaaagtatgtccaagggagcagcgctgctgtttaaaagccagagagggttgaaccaagtcccagagcaaatgcaacctctcactgcccagggttcagcgcacgcctccgctgcatcggatcccgggtactggagtcctcacctttgccccccacccccagctcacggcacggcgctcctgtttgggactgaattcccaggccccagcgccggccggtcctggcttcccccccacgcagcctcggggctcccaccctcccggctcgccagaacgcgtctgcccccaggcccgctcacttggcgtccgaggtgaggcgcggcaggctgccggcgcccatggccgacacgtggtggtgcggcggggnnnnnnnnnnnnnnnnnnnnnnnnnnnnnnnnnnnnnnnnnnnnnnnnnncggcggcggcggcggccggaggcaggatgggatggtgcaccgccgggtggtgcgccgcgtgcgccgcggccgccggatgagccgtggcggcaggcaggggcgcagagtgcgccaggccgccgcaggccgatgggtggaagccggcgtggtggcctccgtagatctcgctcaccagtcgcttcatctcctccagcgagttggtgagcatgaggatgtagttgcgcgccagcagcaatgtggcgatcttggagagcttgcgcaccgacgggccgtgcgcgtacggcatgacctcgcgcagcccgtccatggcgatgttgaggtcgtgcatccgcttgcgctcgcggctgttgatcttgaggcgcagctgctgcagctcgggctccgtcatctgtttcttatccttcttggtggacgacgcggccgccgacgacgtggacgaagaggtgctggacgaggataacttgaagccgccgccaacgccgccgcccagcttgtcccccgggtgcgcgcccgccgcgcccatggcaccgcgcagctcggcgctcagatccggcgggcagtcgctcggcgtggacgacgacacggtgcctcccgtgaagccgccgcccccgctgcccttgctccgggccggcaggaaaaggtcatcgggctccggcgacgacggccggctagacaccaggctggcgtccgagtccatggccccgagggatcgtcgcagccttcccggggtcctcccctccctgggtcctcagagcttccaggacgcctactgcggagagaggaggagagaaacacgaaagagacgggagatcgaaatcgagatcgagcggcactggggtcagtgagagagaaaagctgctcccgcctgcaccgcagcgcggggtccaggcgctggtggccgttcgcttcgggtccacctcgctgtctctggtcttggcatgcaggtaagcttaagtcaccgctctttccctccctaccgcctccccgccgctctcatccacaggttgtttaatccctggaggatggagctctcctctgggagggtggcattctacggtttttatactttctgttaggaatgaggtcttccctggtgactcagacgggaagatcccctggagaaggcgatggtaacctactccagtattctcgcttggaaaatgccacggacagaggatcttggcaggctacagtccatagggtcgcaatgagtcggacacgactgagcgactaacacactaagaaaaagtgtcaagtgagggtttttctttgggaagggtggagatctaaatagagaagtatttatttggttcctcaaacgcatccaccttacctccatcgacaccgctcagcaaacacacgctcacagaccggcagccagcgcccgccacggagcccagactccacgcgctgcgccaggggcgggctgggggctcgttcagctgactggggctggggcagaagaccgctattgtggccccaatttctcgctttggggcaaaagggatggtgcggtgaccttgggaagggccagggcagcgaaaccgctgggagaactggcgggcaagggagggatctggatccactttagcggagctccccgggtcgcagccgaagtgaggggcctctgtccctggggtgtaggctggagttgcttggggcggggggttgagaggggcgggcgcacttaccacggatgcggttagaggagctcggtccccaagactgaggcagagaaccgggaccgggcgccgatgtcgcgtcggtctataatgagcatccgcacctttccccgctcggagggtttttatagccgggtggcggcggcgacggcggcggtggccgcggcgggggcggggagcaatgtgcgggtcttggaggggccgccgcgccaatgagctgggcaggcccggggtgggggtgggtggggggagtgggaagctgatgtcatccgggctaattccgctcaatgaaactcgccgggccgggcacacgcctcctcccagcgctcagccaatgggcgcccgcggccgggagagtcttaccggagggactgcagcgtggaccccgagagggagagtgagaggcaaagcccgaggaggagggagggctcgcgggggaagtgcagagcgccgcggttgggaccgagggagagaggggacactgtcaaatttctattaaaatgcgggaacgcagagtcagcctcggggaggaggtgcgcgggggggctgtgcgcacgaattaacccggtgcgcaaggcgttcagatcttgggttcggatcttctcagataaccctggctactcgggaactgggctggagtctcctcccttcccacccccgtgtgtgtgtgttctcgccacctgttcccacttcgtgggtttcatcagcacgtgggcattttgagccccaaatgtgcacgataaccagggacgaaactcctgctttctttgcactcgaagcgcgcctctaagaggtggcggcggctgcaactcggcaagcggccagtagcgcccccagctgggcgccgggcctggcgaggaggaaggcggggaaggcaagaggggacccgctaccgggacggggctttgaaagaaatcaccttcttcataaagttgacgatggcgcagacaccgggacaaggcgtttgcactgagaaaccgcgctaatgcaggcggagagttgagcccagggtcaggcgtcctttcgtagcatcaggaaccagaggatggtattttctgcaccatttttgtggcggtcaccacgccgtggcgtagaggggcaaagctggcttgtctgcagaaagaagtctcaatcttgggccaagaccgcgggatccaaccctttggggccgagatccatggcgttttaccagtcgcagcctggctcccaaacctggaaatccttgacctccgaggaactaaatccggtctgcagaagcgcccaactgaagtagttctgtggtaccgacgcctccacccattttacagatgggaaaatcgagagactgtgtctgtagtaagcctacgcaggaggggaggggggacccaaactttactttactgtgcacctctgcctgaactgcagatgggggctctggtggttactttatagtaggggccccgtctccccaacctcagacattttatcgtagttgaatttctcacagccatatattttgagcacagaggtttgtttcttcaaatccaggaccctagtagtgctttacactgcagccgcagggactcggccccagtcctctctccaagggggtgttatcagcctcttggttatctgcattatttgggaccttttcatttgtatgcacggtttgaaaaacacaacagacaaacaaacttggctagtagtaattcaccttcaagcagcacagttagaaataaaccaacaaaaccccaggttattgctcccagtttgggggtatgtcttccagtcccttctacaccagaaagccaggcgggctctcccccttgcccccagctcgtgccttctggggcgttatttttcaatccgcctgtttcccagctggctctgcagccatccgttaaataggtatttaaaacatgaagaactgaagcgtggagatgtgtcatccaacggttccagaggatgacccacaacggttcaattaggcgaatctgtcacttggaagaacgcagggagtggggatggggagctggggattgcagagctggggtatttgagtaccattcctttgggcgtcccgggccaccggtaatgaggacattcgtggggggtatgctctgcggacccccagcctgggcgtggacttgtgagctctccagtttgtatctcacaaacaccagaagacgcaacgagtgcgcgcctgggtcgcagtcgctgaggttagtccagccggtggcacgtgtcctggagccccggttccttctttcgtggcttgccaccggcgacggtccttgcgcccgggtccacgcgaatccgcggttctttacgcgctggctccagagcctagagtcggaagcaggggcaaaactcgaggggcccctcctggcacggcgcgagtttagagcctgggaaggcacagtccggagtcaggagagctggcttattcgctagattcccgcgtggacgcgcgtaaggatgctctgggctctggccccgcgccaacgacccgaggcagtggtggccgttccggggaggtgcagcggcgcctcgcggttcttactgcgcactcccggagctcgcctcaggctggcaggtcagcgctgtggaccctttccccaacatccgcatggaggaccccatcctccagttgccagggagttgctcgggggggggggggggggggcggtcagtgtccccagggcttctttagccctggggctggtcggtcgccaaactctcccgagtgtgtctctgagtcctcccaccccctccaggaataatcagaaactagagtccgccactggcgcttgctctcctgtgggttctagggcgtcccggaccttgtccaggtcttgcgcccggcgcctggtgtgcgcgtcctgggagtgtccctggcaccgcgattcccacccgcgcgcatacagccccttcccgcgaaatggagtgctcctttgccggggctaaatgggccgggctccgggagttagttcctggctggcccaggcgtcctggcgctgtcggcctcctccgtcgaaacggaagacgtatttttttcccctctcttttgtgtttcgctcccacaaaagaccgggtgcgtggaggggccggcctttgctcagccgcctggcggcccgggaggcgcttgtgccaaacgggccagggagggctggcgcgggggctgcaaagaagcagacctcccacggcttcgcgggttcctcccgggcctttctggcctgttctcgccttgcccatttctccgagttcctgcgcacattggggcagcgaatccgcccggctgccaaggagagcggcgcccttgcgccaggcggactggggctggcggtgggaggccaggctccggaaagaaaagaaaaaagcatttcagccatcgctcctggtccggaaaccagaagggatgcgcaatgccagcgtttggcgcccaaacgtgagcgatcagaccgcttaggaggcagaactctgcaaacaaatcctgtcttccatgcaagactctgggcgtccctggtggctcagagggtaaagaatcctgcctgcagggcaggagacctggactcgacccctggattgggaagatcccctggaggagggcgtagcaacccactccagtattcttgcctggagaatccccatagacagaggagcctggagggctacatccttggggtcgcaaagagtcggacacgactgagcaactgagactcagctaccggagtcatccaaggtcatctctggctcccgggccccagcccccagcccccagcccaaggcctgacacatggaaggggcttggtaaatactttggaacgcgttcacatgcagatatgccggtgggctggtgtgaaaccaagctgtcaacattcttgtaaaaggatggtgcctgtgtatgtcttcggtttacacagtaaaccaggaggtctgtaatctggattgctggggatatgggagcatttagaataacaggtggaatgacttccacctaatgaccaactgtgagtgtgaaagtcgctcagtcgagtccgactcttggagaccccatggactatacagttcatggtattctccaggccagactactggagtgggtagcctttcccttctccagaggatcttcccaaccctgggatcgaacccaggtctcctgcattgcaggcggattctttaccagttgagccacaagggaatgagcacttagaggtgacctagaggagcctggtgggctgcagtccatggggtcactaagagttggacacgactgagcgacttcactttcacttttcactttcacgcattggagaaggaaatggcaacccactccagtgttcttgcctggagaatcccagggacgggggagcctggtgggctgccgtctatggggtcgcacagagttggacacaactgaagcgccttggcagcagcagcagaagcaagctgtgcctagtgggtcttgggtagacttcatctcatttaatctctccctgaccctaggagggaggagtacttactcccattttacagatggggaaactgaccctcagagggatgtgggcgtttgttcaaggcccctaagcagagggggacgtccagaaagacagcatggtgatggagacaatgcggtgctcgtcacctgaaacttagggatctgaggttgtgggatcttgccttgtctgctcttggcctcaggttctcgttcctaaaatgggtttctagaagctacctgtggtctctaagggtgtgtgtctgccgtaagatttgaggacggagtgggagggttggacgataccttccctttgtgatttctctattctgctaatactgtttgagggactgtgagggtttgagaaatgaaggacctctgcccaggcctggctcacccttgggtatcagctaaaggcaaacaacaacaaacaaaaaaactgtcaaacaaaaccccaaactaaaaaccctttccttccagtcagtccctccatctggagcaccccctccccatcaagtccgtgaccatcacctgctccgaaggagccctgccattgacgtcaacacgcctccccaggctacagcggagtaaagttggaatctgaactgagagatgacccggaaccaactttcacagatcttagtttacaaactgtgatttcacccaagctctgccagcagccctttcgaggcatcttgatcccattttacaaatgaaaagactgaagactgaagatcagggcagaggctgagttcagcccctggccccccaggtccccagtcccggaggcctccgtggcttggtcctacccctccagccactcccctgccatccttgagacactaggcatctccccctctccccactgaggttcatctggaaggtggggatgggctgaacagagagattaatctggagagcgagtccccaggtggggtatgctccacgcagttacagagtgacatggacaaagtggaccaggaagcccctgaccctgccttgggccaagaccttacactggaggaggcagtgggtttctgagtgtgggagaggctcttctaggctacaggtgacaagtctgcaaggccagattctggaaatgggacagaaagtgcatgtgctccccacactccccacgcctgcatagattgagtgtggtctgggtggggagcttcaggctggagggtgtggagtgcctctgagctccaagtgcagaggatacagggcctgagccctgctccgagcacccgatggatggcctgccttgttatcatggaagatgtagcagctttatatctcctcactgccttcaggatcctcaggttgggagttcaaggctaactgccaggtagacttggcctccactggccgctcctccttcccttctcaccctctcaggacctggagcacctggtgggctctgctctcccctcatcttcccccacattcctgtccatcccatcttgtgccacccttccagggaatcaccctcttcttgagcctctagagcacccagagctctctccctactccctgtcagggtccactctactgcagtgagggtctggcttcctcaaagcggggcaagtccctgcgggtccttactgtgcctcaactcgctttgcacccccgggacccagagcaagggacaggccccagatgggctcagtagatccaagttaatgtcggtggttaagacagttacacccagagaacttccctggagtttccacataccacaaaagacaaaaataaaaataacctagcatcagaggtacaagattttcccccttgtcaaaccaaattccaaactgccagatgcggacaacgttggttcactccttgtcacgtggggagagggtcacagattccccccaaccccccaaggcaaacgtgttatcttatcaagtgcgagggcctggaggtgggctcaagagaagggagaggcctgcgggggtcgagaggcccgggggcctcgcgggggccagcatcgctccgggatcccggcagggcccctccagaggcccgagcccttcccccggcttctccggaaggcccagccggcgtgggtctccctagccgcgtctccccattctcggcggtggagcgcacagagaagcgggggacccagctggctatcgtggggggccggccgtccgcaacctccgccgggtgaggaccagcgggcggcgcccagggagaacctcagggcgctccgcaccgcgctcatggccttgggcttgggcttgaaggaggcggcggtacaggagccgggtctcccggtcttctttcccttccagctctcttccccttcgcttctatgagtctcccttcttgtcctttatctttttttctcagtcccctcaaatgcatacagcgcgcccgcgtgcgcttgtacccacacacacacacacacacgtacacacacacacacgtacacatatacgttattgaaatgactcttgccgagctgggaagagccggaaccatcggcgggactacatgcacccaccccctcctgcctctctccagatcctggtggtctggggcccgcaggatcagcattgggaggaagctcgttataaacacccagtcgcaggcgcttccggacccagtgagacagcatccaaatcaaccaaggtccccacgtgattcatgggcacagtcttccgtcttttgggggcgcaggtatgctcctctgcccagggtccttgggacttcgagttccaaacacagatcctttctagggctgaaaaaatgctgttttctggagattccacggtctctccccagcatttgaatagtttttctcactcctttgaccatctgtcaagtaaaattcaataagcattaaaagattaaaaaaaaaggatgcatgcccaattgtaaaaaacaaaacaagaccttttaaatcatacagaagcagaaggcaccatttgaccaactcccctcccccacaagtcacagtcggttttggtgaagtcctttcaggctgtgtgcaggctttgcaacctgcttctttcatttcttagcgtcttgtggacatctttccacatcactgtaagttccacctgaccccttgaacaagttaaggctgcaacaatctgtcccctttggatccttccctcctttgcctgtccagccctgagaagcatgtcaaagccagaaaccctgaaaacagttttcctgtatttgtgccctggtggtgggaggaccctggggtcagggttgctgcctggcaaaccggaagtctaggtttctggcccccactgggctccctggcagttgtggatcatcttggagaagtcccttctggctgatatagtaagaaagactgggcccccttttgcctgcattcagatgtacaggaaacactaacccatatgtctgcagcttccactggctcaaggagaatggttgaaatgtaaacagaacacccatggcctgggactgagaccagggtggaaattctgtgatttttggaagatgcagaagttttaaatattcgatttcctttttctttctgcatttccaacagcaaccccaaaaggtcatccacttctgggttgaccttaatgctaagtgtaagcaaagatgttggtctgtttaggtagaatttacagtctccattgaaagaaggagaaggagaggagtaggaagaagggggtgggggtgggggtggaatagaaagaaactatatcatataaactggattctatcttttttacgtgttttgaatagatgctatatcagtcagttcagttcagttcagtcgctcagtcatgtccgactctttgcgaccccgtggactgcagcacaccaggcctccctgtccattgccaactcctggagtttactcagattcatgtccattgagtctgtgataccatccaaccacctcgtcctctgtcgtccccttctcctcctgccttcaatctttcccagcatcagagtcttttccaatgagtcagttcttcacatcaggtggccaaagatgctatatagcacatacttaaaactcaaatatcacagagtatttggttaaaagttagtttcgtacaactgacctccccacaaaggcaactagtgttccagtttcttgtgtattccagaaatactctttgatagtacaaattatatatttaaaggtctctctcttttcttttttgaacccaagtggtaacatactctgtacactgtcctctattttgatttttttccccctgaatagagaacactctctaccttatagcatgcacacacacatacttacaataatatacctgctcctgaaatgctcaccagagcagtcagagagggtaagaaaattctccttgttctcagtggggtcaagtacccccacctcaaaatggagcatcatagcatcagaatctgggcaggatcctgatggtatatttctgcttctctcagtcacagagaagctaggacactgtgagccaaagataacaagagatcgagggagtgatccctgtcctgatcagtggtgcttcttcaccatgttcccaggatggcacttttagccactgcctaaaacttgcaggggagtccacaaaacaataatttgtcctgtctgaaggaccatcaaccagaaagatacaggcagacatactttaaaaaatatgtatgagaccatgaggtggcacagtggtaaagaatctacctgccaatgcaggagatgcaagagatacaggttcgttctctgggttgggaagatgccctggagtaagaaatggcaacccactccagtattcttgcctggaaaattccatggacagaggagcctggtgggctacagtccatgaggcctcaaagagtctgacttgacagcatacaagcaacacaacaattcaacatgtcagatgaaactagttattattattattattatttgttgaatgagtgatacattcacatagttcaaaattctaagttcagttcagttcagtcactcagtcgtgtctgactctttgcaaccccttggactgcaccacaccaggcttccctgtccatcaccaactcctggaactcactcaaattcacgtccatcagatccatgatgcgatccaaccatctcatcccctgtcgttcccttctcctcctgccttcagtcccagcatcagggtcttttccagtgagtcagttctatgcatcaggtggtcaaagtattggagtttcagcttcagcatcaaaattctaaagcatatcttaaaaagtttgcttccctcttctgtgggctgagggcagctcctcaattcccttccttagtcatcatctcttgctttttcttccagaggtattctatgcaaactcaagcaagcacacaaacacacattctctctttctctgtttgccatttgtgttaaaagggtacaaatggtagcatactatacacttggctttctaccttgcttttttcagttactgtctcggaggtcacttctttgctgtgcattgacagccacttcttccttaaaataaaggaaggctactgtttgctgctgtttagtccctaagtggtttcaactctttgcaacaccatagactgtagcccatcaggcccctctgtccatgggatttcccaagcaagaaagctggagtggattgccatttcctcattcaggggatctttccaatccagggactgaacccgggtctcctgcattggcagcagcttctttaccactgagccacctgcgaagccccaaaaaggaatagggatcctgtaatagggcttcaccattatttatttaactatgcagactttatttttgggggctccaaaatcactgcagatggtgattgcagccatgaaattaaaagacgcttactccttggaaggaaagttatgaccaacctagatagcatattcaaaagcagagacattactttgccaacaaaggtccgtttagtcaaggctatggtttttccagtggtcatgtatggatgtaagagttggactgtgaagaaggctgagtgccaaagaattgatgcttttgaactgtggtgttggagaagactcttgagagtcccttggactgcaaggagatccaaccagtccattctgaaggagatcagccctgggatttctttggaaggaatgatgctaaagctgaaactccggtactttggccacctcatgcgaagagttgactcattggaaaagactctgatgctgggagggattgggggcaggaggagaaggggacggcagaggatgagatggctggatggcatcactgactcgatggacatgggtctgagtgaactctgggagttggtgatggacagggaggcctggcatgctgcgattcatggggtcgcaaagagtcagacacgattgagcgactgaactgaactgaactaaactgattgccctgttgaaagacaaatttataatgtttgaagtcttatcctattacaaacaaggatgcaaaaaatatcttgtagattgtcatgttcatatatgtagcatatcatgtggataaatccctagaattagaatttttaggtcagccagtctatgcagttgtaattttgatacatgttgctaaaatttcacccaagtgttgtcccgatttatgtcacaatgtagaagagagtctgcctggctgatagctaacttaaaggctcagtctttattttcctgaatgcaggggaaatgtgatctttaatttggatgtcatataggtgataaactgacctctgtgactcttcaggatagaatagtaaaatgccatttcccccttcaaaacatcaagctacaaattgtaatagattttgacatctggtaccattttcagtcctttcaaagatttactaatgacttttccaagtggttgggtagaatgtttcaagtatgccagtgccttatctctgctgaggaatatttatcttcaagcatataatccaatagatacttactgggcttctttcctgtgccaggagctgtcctaggtactagggatccagcagtgaaaaaaaaaacaagaccacatctctgctttcaaacatggtaacaaagtaattactatcatgatgattattataatttctttggattctctcaacagccctgaagggtggttccagtaggatgtatgtgataaaacctactgcccccaattcgtgtggcgaacagtgctagttgctcccccagatctgttctcccttctgtatggagcttctgattgagcacatagccacccagaacaaggactacatttcccagcctcctttgtaaccaagtcctggccaggaggatatagacacaagtggtgtgtggggcttccggtagggtgtccccattctcttcctgctggctggaatctcgacctgatgggtcgggctgtaagaaccatcaggatggggacacatatgaaaaagctttaagagaggtgcctgggttcctgacactacagggaggggataccagacccacccaggatcaagcctttgttctctagatgagagcaaaactcctctgctttgctaaatccattgttgtcttgggttttcttgatgtctgaagaggcatctctccactgcagacatctttgttctatcagttgaggctgacttttaattaacatagttgttgctgttgttcagccgttcagtcgtgtccaactctttgtgaccccatggactgcagcacactgggcttccctgtccttcaccatctcctggagcttgctcaaactcatgtccatcaagtcagtgataccatccaaccatctcatcctctgttgtccccttttccttctgccttcaatttttcccagcattggggtcttttctgatgagtcagctctttgcatccagtggccaaagtattggagcttcagcttcagcaccagtcctttcagtgaatattcagagttgatttctcttaggattgacggggcacaatcttaaccagatgacattgcaccatgttatgaggccatcctcccttcagaggagctctgaaggtgcccatcttggtccctcgctgtgtcattcaggaagcagtgttactgaggccaagggggaggtggggacagccagaaccctgggcagaaagctggtgtgaagtgggcagcgtgagtttctaggagatgagcatccctgatgagatgagggcaggagacagctggtgggaagccagtcctggcccctcattcaaggaagggctgttcctggatcccccaggacaatgtgggtgcctgcattgagctctgcctaggtctgtcttggtgaggcaggcagctattcccaaggggcaacctggttcattcagctgcccttggtccctaactgtgacactgattcaggcagagcctgccacctgagcctccgtcctggggctcagggcatggatttcagcaggagccagcagatctcctgatggtgtggggcttccttccaggactattttccaagacttaaaaggcttcttcctcattgaatgacagtgccccctaccaatatgtccatgtgaaaatccctgaaaattgtgaatgtggccttacttggaaaaacaaaaaaggtcattgcagaatcttgcaatcatcctagattatccatgtgggccctaaatctaaagacaagtatcctcataagagcaagatggttgggggcggggcagtgttggacacttgacatagaagaggaggataaggccacgtgaagatgaaggcagagactggagtgatgccaccacagccaaagactactggatgtcgcaagaagctggaagagggaagcaagaattgttaccaaagactttgaagggagcacggccctgccacctccttgatctcagacttgggacctccagagctgtgacagaatcgatgatgatgttttaagccaccaaactgttgtttgcagcagccacaggaaacgcttccaaactggactcagctattggcttggaggtgagaccttggtgggagtcggtgtagaacgtcaggaggtggggtgagctttctgaggaccaaagccctccacgtggggagatctacacactggagaggctggggagggaggcttcagggacaggctctgcagaggctttcttgtccctgccccatgtatctctctgtctcaggggctaggatccagcctccactttccagaggaccacccctgctggagtctagaggtgctgttgttgcccctcccactgtgagagcatcccaggtgttactagttgtaaagaacctgcctgccaatgtaggagatacacaagatgcaggtttgatccctgggttgggaagttccccaggaggagggcatggcagcccactccagtattcttgtctggagaatcccatagacagaggacctgataagcaggctatggtccatagggtcccaaagaactggacatgagagaaggtactgcaccatccacacacccccaacccccactcctccccaccaccccaggtctggagaagcagccacagtgaggctccacctgcctggcaaagcctgaggcaggggggctggaacttggatggagaaggggagggtcttatgtctccattacctccccaggaagggtagtcaaccacaattttctaaattacagaattaggataaagatcctgaaatccactgtagaacagaagaccatgttttgatttcaaattgggtgtctttgctccctgacaagggctaaaccatgactcagcaccccattcaagacccttgtgccctccaggatttctgtggtctgttgactgttgcatgtgacaccgaggagggtgtcctcaccccaaaacccagttgaccgtctggctgacttgtcagtctgtaaaaagggaatcagtataagagagtccagatgcgaggtcatgggacggcaagcagagaaacatggcaggagagaagagacatcaggcaggacacagagagtgtccacggaggcttccccgagttcaacggtgacactgatttcctcaaaatgcatggattattgtttttctgataacagaagtaaaacatggaccttgttagaaaaatctggaaaataaaggtttcataactgtagaaaacttggagaattcagggttttattgtagttgagtaggatgtgacaagggcttcactggtggctcagactgtatagaatctgcctgcagtgcaggaggcctgggttcaatctctgagtcaggaagatcccctagagaagggaatggttacccactccagtgttcttgcctggagaagcccatggacggaggagcctggtggaccacagtccatggagtcgcaaagagtcggacgtgactgagcgactatgctatatgctatgaaaggtgacaaggaccctgttaggggctgaattgtatcccccatcctgtgttgaactcgaaccccattctaactcaaaatgtcactgcatttggacgtagggtctttaaagaggtcattagggtatccttataagaagaagggatcaggccatggacacacagaggaaaaagcaggtgaagacacacagagaagacagccatctgcaagccaaggagacaggccctcagaagacaccaaccccgggacgtccctggcgatccagtaggtaagaatctaccttccaatgcagaggatgcaggttcgatccctggtccgggaactgggatcccacattccttggggcaactgagccaacacaccagaatgaaaagattccatgtacagaagctaagacctgacacagccaaaaataaaataggtaagtgaatgaatttttttttaagtggaaaaaaaaaatacaccaaccttgcctgcatcttggccttgaacttccagcttccagatctgtgagacaatgactttctattgtttaagtcacccactgggtggtatttgtaatgcaaactctagcaaactaatagtatgggcacagtggcaggggtgtggagaagggatgatggaggaagatgttcccaggtggtaagaccggccagcgttatggacagtaggagtgtgagaagtttagggtcttaatagctttctaagcttgggtagcttggtggacaggctgtcattccaggtcatcgactgagatggagagtccatgggagaggaacaggtgtcttggctgagttgagttggaggtgcaagagggactcccagggaggatgactggagccagagggggatgctgtccaggggatcaagcaagagggctggaggggaaaccaagagcacattggggcgagtggaaatcatcctgtgagtagaggaggttgtccaggcccagagcggctgatggaggagtagaggaggttgtccaggcccagactgggacggaggacagcccctgggaggctgacactgattttcatctttgaagacgggcccctcctttactgagcggatggtctgcaccgcagctgctcatgtttattacgtggattccaaaatattgtctgcttcccccgatttctctttcaacccattgcttacaaaattcccaagatagacacagactactccccaaatgctaaataggtcaaattaggggaaaggctgtctctgtaacctgcccctgtgattattatttggtgctcactcaacttagcctgccggtttccaagggccataagtgtggggctgggtgggcaaacaacgggctatttcgctttgagtgataaatgtccttacctctttgtactccatgggcctccttcctttaaagatctcttctatgggcatgagtttgatcaagctctgggagttggtgatggacagtgaagcctggcgtgctgcagtccatggggttgcaaaaagtcagacgtgactaagagactgaactgaacggactgaatcccaatctcccaatctctcctctacccttactgcccatacatttgatctctacatctgtgtctcttctctgatgcttttccatgtgaatttaccagctcctctctctccattaaggccagatcaactaccatcctgcttctgtttgagaaatttcctcctttgagaaaagaacatgcctatgccatctctttagcacaatacgtttgggattccggcaagtttctgtaatttgtttccctatcgggcccatcaccattatcccactgttaaagtattcagttccacttttaaaaagttttgtaaaatccttcaccaagcagaagatgccaggaactctcctgcctgacattttattaagagtgaaaaataaggaagccaacagagatgtagagggaggctaattgagaagcccggcatgatcgctgcaaaccccgcatgatcgcgctgtaataatttgttgacagtgtggtgtttgtgggggaagggcgacgggggaggcggagggcagggtacacggccctgctcctccaggccttgcattaatggagtgacagctgaactaagtgttcagattgaactcatcaaagactggagtctttgagagaccattccttctcgtccaggatgtcaaaggtggccgcagatatatccagcgctccctgggtggcattgtttaggattctggccccagcagatggcccccaaatgtacctcagcctggttgagcagggaccacatgggatggtatagtcttctcattagcaaacagaaaaaaaaaaaaaaaaaacaggcaaggatgagaaaggagagagatgaaaagaatgcacaaagacatttacatatttacattgtctctatctcgcatttcaaattctcctttagctggagagtcagtgggcttgcttttctccttctgtttgtgtgtttacttgtgctaaatagattatggtaatcaggcacataaatgcatgcaactgttattatggcattttaatcacagagtttttcactggaagccttcattagaattctcgtaatcttacttgttagtgtaacaaacagtaataaatgccaaggagcttggattaaggcagaggcatccagactttaaaagaggaatatggaaatgttgttgaatctctgcattacttattgaaatgtcacatcaacagttcgggactttaaatatcttactcattaaaaggatagggaaccaagcaacctgaagacaataatggtgtttttctacggagcgctataaacatatgccttccacagagtcctccgaactctcctgcaataactggttggtctgatacacagtcctggctctagtttattagtgttaaaattggagacatttattattaaataatttcatttattttacggttagtggtaagtatgtgcaaacatgaacatgtcaaaacttcctaattctcattatccttcaaatttatactattgtttggcaaactggtaggaaaagtggcagggttttttgttttttttttttctaataagcagtaccagagtcatgtgcttgagaataaaccgctctttctgcaaagagttttgcaaacagatctaagcatcaggacacagtagaggaccatcctgattttactggagcccagaatttaaatctgatgatatcagttctgggggaaactccccacttccatttatctgctgctgtgtgacagggtacaagacttagtgacttcaaacaataacagtacgttagttctcatgagtctgtgggctcaccaggcagttcttctgtttcacctggtgctggctgagatgcagggttagctagaaggtccacaatggatgctcagctggagctgcttgacccatgcctcagttctgctctgctggagcatccccacccggcggcctcggcttcctcacaacatggcagcttggttcaagaagaaagattcatttgcagagacgtggatggacctagagaccatcatacagaatgaagtaagtcagaaagagaaaaactaatatggtatattaacacatatacgtgggatctagaaaaatggtagagatgaacctatgtgcaaagcagaaatggagacagaggtagagaataaatgtgtggacacgggttgcaggggggaaggggaggtgagagaaattggaattgacatatgcatgctctgggtactgtgtataaaatcaataactaatgagaacctaccccataacacagagaactctgcttattgctctgtggtgacctgaatggcaaggaaatccaaaaaagagaggatgtgtatacctatgatggattcactttgctatgcagcagaaaataatacattgtaaagcaactgatgtttgtttagtcactaagtcgtattcaactctttgcaaccccgtggacacatagcccaccagactcctctgtccatgggtttctgcaggcaagaatactggagtgggttgtcatttcctcctccaggggatctgcccgatccagggatcaaacccacatctcttatgtctcctgcattgacactccagacccaccgaatcagagtaggggtgggtcctgacaacctctccttccatcaagctcccctatggattcttctgagtgctcgagctctggctcatgtacccttggtatggacctgtagatctctggaaagctgggctctttctggtctgggccatgttgctgctgctgctgctcagtcatatcagactctgtgcaaccccatagacggaagcccaccaggctgccccgtccctgggattctccaggcaagaacactggagtgggttgccatttccttctccaatgcatgaaagtgaaagtgaagttgctcagtcgtgtccgactcttagcgaccccatggactgtagcctaccaggctcctccatccatgggattgtccaggcaacagtactggagtggagtgccattgccttctccgctagaccatgagttcaccctatttttccctttaggttgaaacaggtgccctggaaccagctgatcgatttcctctggccgggggaggggctcccccagcagcaccgccccccaccccaggaggattcaagtccttatttggttttctccctctggcccatttagtgccgccccactgtccaccgccggccaggccacatctcccacactcccagtgtgtgttgctgtattcattgctcagttagtgtgttgcggtggccgctgtgtgtttcatcagctctgtcttcactgccttgagcacatccgggctaaaagagctgaaagttagaagtcggctggtccccagctgcccaccttatagatcagcagctgattttccggaaggtgaaggccctggcccgaggccacacagcaagccagcggcagagtcgggatctgacctgcatttcttggcctttcctccaaccacccagcactgtcactgcctgtcccgaccagtggcaaaagccctccgctccttgatggttcctcctgcacctgccctcctggtctttttaaggttaagggccgctgaatttcctccttaatgactcagaatcaaaagcgatatgtacctgtttcagggttttctcgtgatcattctttgaatatgactagtctgttaatatatgtttttaagatcttagagtgcatgcatacgcacacctctgggtggccacgatccacagggaatgggttgggtttggggggagcggttgtgactttccagagagtcagaggtaacactttgttatgctattttttggtctgagaatggagaacagagggaaaaaaaaaaaaagaaggaaattattgatcatgaaaagtggtaaatctacaattgagagactcacagagtgcaatcccatatgcccatcacccagtttcagcaattatcaactcacagttggtctacaccctctccaactcctctggcctgatgatcttgaagcaaattccagatgtaagagtggggttaggatccggagatgcactggtgataaaattcttcggttattctccctgccttcataagcatgtctcagcagaggagcttggagacctcagcttgagggagaccaggagcgaaagcaccagtctgtgtgatactccagatatgcaggggcctggccgtcaccaagtccagtatggggagggcagctcttcccccgtggatcctgccgggtaaagccattgaaactgcttacagtcaagcttgaaaaccacatatagattccccgtcccccacccccaacccacacacactttttagaaaaagtatttttaattggaggataattgctttacagtattgtgttggtttctgccatgtaatagcatggatcagccatcggtatacatatgttccgtccctcttgaacctcccccctccaactccagccacatcccacccctctaggttgtcacagagtaccacttcaagctcccagggttatacagtgacttcccattagctatccattttacatatggtaatgtatattttcaacgctactcccttaattcatcccaccctttccttcccctgctttgtctgaagtctgttctctatgtctccatctctatttctgccctgcaaataagttcatcagtaccatttttctagattccatatatatgcattaatatatgatagttgtttttctctttctgacttatttcactctgtatgacagactctaggttcatctacctcattgaagtgaagggaagtgaaagtcactcggtcgtgtacgactctttgcaaccccatggactatatattcaccaggccagaatactggagtgggtagccgttcccttctccaggggatcttcacaacccagggatcaaaccagggtctccttctttgcaggtggattctttaccagctgagccacaagggaagcccaagaatattggagtgggtagccttatcccttctccagtggatcttcctgaccctggaatcgaacctgagtcctcgtcttttcttctaacaaagatctaatttcgtttatggtgtcattttgaccatattaaaatatccatcttcccagactctcttgaagttaaggatggccatgtggccaaagcaatattggcagaaatcctaggaatggcatgcactctcacaagaaaacacaaagcttggaggaaaaaaaggctgtagtctttgcctctcttggtgtctggaatgtggacagcatgcatggaggcgcagcagccatcaagagatggaaagccaagaacgacagagcgggaagagcaaacccatccgaggctcagtgggcactgccggtcaagcagccgctccaagcctctgtcatttacctccagcttccttgctctgtgaggaaagggacccccttagggacttaagtcatattgatacggtctgctgttactttggccagacataaactaaactcttatgccagcctggagagaatggcaaagtcatcggtgggcattttccattctcagagcagcagggttcactttcctagcgactgataacaaaacagttatttgacatctattgtccaggtgtttattttatttagcaacatggcttcatcttttcaatgagggaaatcgctggttgactccatcccaaatggttccgtatatggaaagagatgagagtttgaatggccactctaagaaccttgtacagagttccctgggggcatcttcagttcagtactttacttctttgtcattgtaagagtgattaaaatagaaaaagaaaactgaaaatcatccaaaattccactagtagaaatagccattaatatttgctataaataagtccaggcctctctttgtgaatatggatacaagaggtatgtgtatctgtgtgtgggtgtgtgtgagagagagagagagagaaagaaagagaggttgagggtggaaaaggcatcagctggccaattttatctttttaaaggctactgtgattgggatttcaactcgggtctatatattttgaaaatcgtcatgcttccagtacagtttaccacttctcaactgagaagatgaaagggttgcacttagcttttaagtatcttcactgatgaaataaacaaaccaaataccaatgtaaataaagcatatggaagatttccgtttacttattcccatcaattgccaacatatataatgctacgttttaagtaatgcccattggctgattacttgatcctggacacccagcaaagggaaagcagtcgctacccatggtcctcagtccttcgctctctgtggcaccgtccgtggctcagcagctgcccggaggcctccatggcggcaacatcagacatcgattatctttggaggccaattcagaggctaatccaagcttaggtcattacgaagtgaagaattctcatcctctatccaataaattaatttcctcattaccagatgtgatcattagagtctgaaattatgtactggaattacatatgggtatttgttcaattaaccaacaaatatgtcctgaaagcctgctaggtactgttctaagatcattatagcaccaataaaattagcaaaatccttgctcccatagaccttacattctagtaagtgatggaataacgcctccaggtcagtttagagacagatacactacaaaactcaaaagggaagacaggctgaggggacaggttacacagtatgtctctacctattgaaatcctctgcagatgtcacagctgtctcataagagaatcatgggctgttcatgcttgatgagtgccaagctctaaggcttcctttattgtttgttttttaataagcttgatattacagtgatagaagactagaaatagagagtgtaatattaaaaactactaagcactcatcaaccagcttcacttctatcagtccagtccagccttgtttcatctgcatctccacccatccccctccttctggataactttatagtgacattaaatacctttatttgcaaacatttcagtacatggtttaatagataattgttatttgaataaacagcaccatgatatcatcatgtcatactttaaaataacgttaatctcttaatatcattaaatattgtcatcttcatattttcctagttgtcttgcaatttttaaatggtaaaaatgtttgaattatcatccatacaagtttgctacttggcaatttctgaaacagtttccgaatcttgtttatctgtatcaatttcttccttctttttatttctttttccaaaatttgtattgtttttgttgaagaaattgaaccatttgtcctttagagtttctcaccatctggtttttgtttatttcatccctactgtgtcattgaatgtcctctgtcccttgtatttttgccaatttgtatgtcaatatctctccagtcattttttattttattcctactaattttctaaattctgtcacctcttttttgaaattttctttttgtcatccaccttaattctgagtttttttcctctaacactgaggtatgttgtcttgtcatatcgtctatcattttcttaaatttcctttagcttgatttggaatatttgaaaagttccatgaacatttcttcctagcaggctttcactgtagaacttttatttttatgttttctttttctttctcttaaattaactttttatggatttctcccacagtgcttctctgttgttcattttctaagtgaaatgaatcttcctcttctttcaggagtgaagggtaggccaggacagcctttctacttctcaggctctacagctgtctcttctggtttttcccaaataaataataaaataaaaatcttctggcttttccagagctccctcctctgctctgcaacttcagcccattcatctggatctttgttccttgcctctgtcattctgtgcagatgttcctcagtgcaaggctttgtatgagatggaggtttgtcactctgaaagcaacgagggcccaacccactccaacaccatcgggctgttggatcagggccccatcggacttaaccacgttttgagtttatagaacccgctcctggtttcagtcgctctactcagattggtttgctgtgccctcaagtaaatacactggtgactgtaatttcctcatcctcatcttcagaaccacacttttcttccctgctttctcccagccctgatgctgcaggtcctgggcggcctcagcctgcgaaaccttggagctgagcttggattcccagccagagattgggctgggtcacggaagtgagagcaccggatcctggccactagaccagtggtcagtaacaagggtcctggcttctgcctttgcgaaaaagaaatttccacaaagacagaaagtagtgaatcaagcagagtattcatcaagaggaaaaaatgcactgtacctgtgggtagacacatgggtggacttagggagagagacagagtccctgggtcatgcccttgtggaagtttgaagcacttctatggggcatttattccgggtttctttggtcaatcattttgatttgcctggtttgcagtccgtatttggtatatctcaggatcttcccatgtgtgtgcacatatctcagccaacgtggatattaccaaaaaggcatctgagtagcctggccttagttagcagcactcccctttgacttctatggagcttttctgagtatgtgcggttggggaatgaaaaattacgtggtctgggcagggccagcctcctcccttaattgccctactattctctgtttcagtccatagggaaagggaaagtgaaagtcgctcagccatgtccaaccccatggactgtacaattcttggaattctctaggccagaatactggagtagatagcctttcccttctcccagggatcttcccaacccagggatagaaccagggtctcctgcattgccggctgctttttaccaacctagctaccagggaagcccagactttagggaaagaatctccaatggctttactctggggggcccatctacctcctgcctcactgctaccacacagttcttgacttttggcagctctgtccagacctgttacttttggtgtttggaggggattgaatcatcgttgttgtaaatcctctccatggctctttagctctgctagattagttctactttatggggacattttgggaaattctaaaactacccagctatttctcataccctttttgcctcctcttggtacctggtgtgatatgccaagggagtagatgagtgatcatttcaggttaaacagagtttaagagtcccttggagattaaaccagtcaatcctaaaggacattgaccctgaatattcattggaaggactgatgcagaagctgaagcttcagtactttggctacctcatgtgaagagccaactcattggaaaagactctgatgctgggaaagattgaaagcaggagaaggatccacagaaattgaaatggctggatggcatcatcgactcaatggacatgagtctgagcaaactcttggagatagtgaaggacaggaaagcctggcatgctgcagtccatagggtcacaaagagacacgactgagtgactgaacaacagcaacgacaactcaatgaaatagcccaactcagggatgggctttctcacaggagccatgactcctgtttcattcagtgttttcagggaagcagataaggtgagaaaaagtggacaggggatgccaaagaacagcaatagtttaggcatagctcttagaacctgcataaaggccacagcgctgacctctgcttctgacccctcccctcccctccactagccaggttctcaaggaaagaaaaaaaaaaaaaaaaaacctacaccagaagtgaagggaaaacagagctaaactctaaaattctagtgaactgcctgggaattcgctaatattcagtattcccaggtttgcatctgacagcagctttgcattgttgggggagagttgccctgcttccctcccccaaccttcccttttctcttcccctcccccacgcctgcctgggctcactccgttttctcgagcttcctgggtggtgcagggttgtgatgtcttgaataccaagagtgaggctgaacatatgtgaacctttcctaatcctgctaatctgccttcaaaaacctttctcaaagtgtaggcaacatccagattgtaaaaagagagccgacgtgagcctgagcattttaatgacaagtaatctttgtccaagggggggggggggcggctcactcagctggagatggagctgatggactacagcaggtagaaataacgccggtattacctcctgtaatctccaccattcaggggcagctgaggtctgaatgtgggaagaaatcgacttggcttttcaactggagactttgcacccacgatggctattaagcggtaattagttgtgacacagaattaccagccccacaatggtagaggaagccttgcaaggcctttgaagctgattagagaaactgaatggatgttacttgcgatttaaaaaagtctgttcagatgtgaacatgagttaagacttccctcctctctgtcccttgttttctccctaccaacctacgaatggcaaacctctccagagtgtggctgtctaagctgggcaaataaacgtgtctctgggactagcatccctcaagatgatcagataccaactggtccttcaaattccaaaccaaagggaagtgacttttcagagtccattgacagagtagaatcagggagatttaccaggtctattaaaaaaaaaaaaaaagaaaggatctaggagccagctgtgcaagcagtggggcttccctggtggctcagatggtaaagaatcatgcagggacctggattcgatccctgggtggagaagacccccctgaacaaaggaatagctactcactctagtattcttgcctgggaaatcccatagacagaggagcctggttgactacagtccgtggagttgcaaagagttgggcatgacttagcaagtaaacacacagacacaaatatatgtgtcagttttgtcttactctctatgatttctaaaattatttgcctaattctttttattttctgggattttcattccgctatagatatatttcagtttatatttttccttatatttgtcttgttaagatgttgtttggttaagtttaagtgaaatattcttaggtctctgatgtgattattatttatccttgttttcagtgaaaaatgctttatctgactatataaattatagcaattgctatgtaagaattgccaccaaacacttcaaatggattaaaccatctcctgtgttttttttgttgtttgttttacttgcatttgttttttgctgcatttatttccaggccagaagtttttgtttcttccgtttcttctgggatatctttttcttgcgtgcaaccttgtcttctggttttggaacaatctgttctttttcactaaggatcatctcagtgtggcagggagagctctgtatgggttcatccaaccataagctctgttaagtcctgcaccacatcttgggggctttgttcacctggatgtgcccaatgacaagataatctacatctaagcccttaagttcagcattactctttgcatttttgaacatgtgcagtaaaaattcaacattctttttgggccgccgaccctgggcccagccccactgtgtggcctgtgtacgcctaccaactctaccactgtgacaatggaatggcacaccttgctttttaaggtgacatcttttagggagttggtgggtcttctgatatgcaaacacttaatggcctgggcagtttcatgagtgttcttaaagtgaatatgaagatttgaactcttgatttgcatgactttgtggagttttctgggtcaagtgagtagcacaccattttttgaagtcacttcaggccacttaccagaaaaggaaagcctcccatattattcttaatcaacaacttcaaggaaagcctcccatgttattcttaatccacaacttcaagctgaaattgcaagaagtcagaggagaatgcatctcagagagataaaaataataaaaatatgtgagagcaattcagccatctgaaaaacggattgagaggctccaataggtatgtcatgggtgtttcagaagaatacaggacagaatgtttacaattaaagagagacggaaatcttcagctagcaagtgcgcagtaaatgctgtgccaaggcccatccatcagtaaatccccgcttaggcgtaatgtaatgagacagagataaagagaagagtcttacaagattttagaaagaagatgaataggaataaaacttggactgagaatagggcttccctggtggctcagtgagaaagaatttgcctgccaaagcagggacacataggtttgatccctgatccaggaagatcctacatgcagtggggcagctaagcctgtgcatcaaaactattgagtctgtgctccagagccggggagccacaactattgaactcacatgctgcaactactgaagcccaaaccccctagagcccgtgctccaagcaggagaggtcgccacattgagaaacccaggcactgcagctagagagtagcccccactctctgcaactagagaaaggctcgcacagtaaccaagacccagaacaaccaaaaataaataagcaaataaaatagtaaaaacaaaagcaaaaacaaaaaacttaggctgagaatagacatcacaaaaacaaaaaacttaggctgagaacagacatcacattagcagaaatgaatatcaggagacaacagaagaatatctccaaagtagtgaggacacataacagcctgtacgttggaggagtggtggggagggagcaagaacaagaccaaggaggggttccaaagatgcacccacagggtctagaatcttccctatcttgaaaagatctccagcaatgagacaaaatgtcaccatttaaaaaataattttaggtatttatttatatttatttttggctgtgctgggtcttcattgctgcgctggccttcctctagtagtggcaagagggggctactctgtagttggggggctcaggcttctcaccgtggtggtttctcttgttgcagagcacaggctctggggcacacggacttcagtacttgtggcacataggctcggtagtttcagctcccaggctcagttttgtggttcgtgggcttagttgctctgcagtacatgggatcttcctgggtcagggatggaacctgtgtctcttgcattggcaggctgattctttagccactgagccaccagggaagcccaaaatgtaactatttttttacatttccgtgtcaagtccacagatgtttgttattttattttctgagatttttttttctcctgtgtttggaatatattattctaaaacagggggagattagatggaaagaagtgaataaaagagcaaaaacccatgtgtgtgataaagtggaggcaggtgtgaggcaccaaaagtgcatgtggagtggacctggtctttgacctagggaatctgagggtttcatctacatgctcattggaaaacccagggtccccttgcctggccagttgtgttattcagtcagtaagttgtgcccaactctttgtgaccacgtgggctacagcatgccaggcttccttgtcctttactatttcctggagcttgctcaaattcatgtccattgagtcaatgatgccatccaaccatctcatcctctgtcagccctttctcctcctgcactcaatctttcccagaatcagggtcttttccaatgagttggcagtttgcattaagtgaccaaagtattagagctttagcttcagcaacagtccttcctatgaatatttagagttgatttcctttaggattgactgatttgatttccttactgttcaaaggattctcaagagtcttcttcagcactacagttcaaaaaagcctgggtggttacagtgtctgaactccttggcctctcctcttctttgcattctcacctctttccttgttcccttcccaagaaggattctgacgccatctttctttacccacactttggctgtatcttttattaatcctgccaaaccattcccacagctccaggaagccttttccaagaatacatctgctccaggaagagtccaaccttcatactactttgggcttccctggtggctcagttggtagagaatctgcctgcagtgtaagaaacctgggtttgatccctaggtcaggaagatcccctagaagaaggcatagcaacccactctagtactcttgcctggagaatctcatggatggaggagcctggtaggctacaaaccatggggtagcagagttggacatgacagagaattcactttcactttcatggcttatcattgccacagaatcaaccactttgtgaaaatcatggagttaccactccctctccttccagcctgagaactctaaagaccttccaacaaggggggaagaagaaggggaaagctacagatgtaactgggaagagctgcccagactatttcagagacgtagttgcagggaatggtgggaagggagcactggaatcctttggacccttgacttatctcttcaactagagagttaggtctctatttaaggctggggccatcataggattctttgatcttatcctggctctgggtgcatggttaataatcaacaaactattctacagaagtaaataatttcttgaactgctgcatcaagagctgggtggtagtggtaatgaacttgggttccagaccaagctgacttgcctttgaatctcagttccctcactcattagctgtgtgaccttggccaagtttcttagcttctctgagccaccttttatgcatctatgaagcaaagactgtaagtgtgtccatcccatagagtgcttgtgagagtcaagagtgtcagtaggcttaagtcaggagttgggaagtttggttcctgctgaggactctgagggagagtctgagttttctgtgagctctggtgatgactggcaactcctggcatcccttggcttgtcactctcatctctgcctctgtcttcacatggccttctccttgtgtctttgtctttgtatggctgtcttcctataaggacgccactcagatggattaagacccaccatactcctgtttggagacacaggagatgagagttcaatccctcagtcaggaaggtcccctggaggaggaaatggtaacccactccagtattcttgcctggataattccatgggagcagaggagcctggtgggctacagtccatggggttgcaaagagtcagacatggctgagcaactgagcatgcatccgatgcctactcctgtttgacctcatcttaactgattgcatctgtaacaaccctgttgccaagtaaggtcacatttttgaggtcctggcgggtagaatttcaaaatttatttttggagggtcacagttcaactcaaaacaaatatctactctggtcctttatttttttagtttatattggtgccaagttgattgacaatgttgtgctaggttcccatgtgcagcaaagtgatgtagttacacgtatgcgttccttttctgttttagttattacagaacattgagcagagttccctgtgttataccttaggtccttgttggttatctatcttaaatataagtaagtgttagtcgctcagtcgtgcccaactctttgcgaccccatgagctgcagcccaccaggctctgctgtccatgagattttccaggccaaggacactggagtagtagtgagtacatgtcaatcccaagctcccagtctatccctccccctccacttctccttggaaaccaaaagtttgttctctaagtctgtgagtctgtttctgttttggaaataaagtcatttgtatctttttttttagattctagatacatttaagtgatatcctatgatgatacttgtctttgactttcttcacttagtatgataatctccaggttcatccatgttgctgcaaatggcattattttattgttcttagtggctgagtaatattccattgtatatatgtaccacatcttctttatttgttcatctgctgattgacatttaagtcttggctattgtaaacagcactgcagggaacattggggtgcatgcatctttttgaattaaagtttttctcttttatatgtccaggagtgggattgctagatcatatggtagctctatttttagtttttaaggatcctctatactgttctcctccagtgctcttgcctggaaaatcccatggacagaggagccccttaggctgcagtccatggggtcgctgagggtcggacacaactgagcgacttcactttcacttttcactttcatgcattggagaaggaaatggcaacccactccagtgttcttgcctagagaatcccagggacgggggagcctggtggcctgctgtctatggagtcgcacagagtcggacacgactgaagcgactcagcagcagcagcagcttactgttctcagtagttgatgtaccagtttacattccaccagaagtgtaagagggttggttcccttttctctataccatctccagcatttattgtctgtagtttttttgttttttttgatgatggccattctgagtggtgtgacgtgatatctcattgcagttttgatttgcatttctctagtaattagcactggcaccccactccagtactcttgcctggaaaatcccatggacagaggagcctggtgggctgcagtccatggggtctcgaagagtcagacacgactgatcgacttccctttcacgtttcactttcatgcattggagaaggaaatggcaacccattccaatgttcttgcctggagaatcccagggatgggggagtctggtggcctgctgtctatggagtcacacagagtcggacatgactgaagtgacttagcagcagcagcagcagcagtaattagcaatgttgagcgtcttttcatgtgcttagtcatttgtgtgtgctctttgaagaaatgtatgtctgctgcccatttttgattgggtttgtttttttttaatatcaagctgcatgagatgtttgtaaattttagagatgagtccctttttggtcatatagtttacaagtattttttaattgagttatttgtctttttgattattaagttgtaataactttttatatgttctacatataatccccttgccagacagatgatttgttccttctacatttgttagttggcattctattgtaaagaaaaatctttctcttcttcatttgtttattgctcatttatttatatcagtgaatgtattttattcagtggatactaatgtggtaatctcattgtttattttgaccctcagttgtcctagctttggccgactgggagctgggttcaagctgacttctgttttcatcattttttgagcatttcattactttgtgggacaataaggtattccaggttcactttccaccttctctgtcccagccctgtatcactcctccccaacagagattttgttcctttttggtgtaggagtacttaccaactaggatctgggtactcagtgggtttattgttactgaggtgtcattatctcgggggaagaatcattaagtatatacatgtgcaagggtacatatacatctgctaactgtttccctttcaatatgtgtgtatacataatatacatacatagtatgtttgtgttatatatacatgagtaaaatatgtaaatatacatactaaaattattttaaaatgtagttctaattctcctccaataccccatagttatttctagctttctccattaacaactttgtaaatccattctctgaccatgagaaaccagcttcccaccatcctcaatgtatttgcttatttgctcatttaacatactggtttagtgtaaccagtctctacatcacttgggcaactttctcttcttactacacccaccgcccaccccacccacggtgcccagcctcttggacaccaggcacgttgctgctgccacctccacgtgggatgggagggggcacaggtagggaagaggatgggaacaaaaggggacctatcatccctgtaccggagaaggcaatggcaccccactccagtactcttgcctggaaaatcccatgggcagaggaacctggtgggctgcagtccctggggtcgcaaagaatcggacacgactgaacaacttcactttcacttttcacttccatgcattggagaaggaaatgccaacccactccagtgttcttgcctggagaatcccagggacgggagcccggtgggctgccgtccctggggtcacacagagtcagacatgagaagtgacttagcagcagcagcatccctgtacaaggactcaggtgataaatttcatctaactttcaacgacaggaaaaaaatagtttcagtttattttgtaatcaacttggaacccaaccttatcttctatttgcctggagtgacactttccctccatgctctctgctcagaagatgcatactcatgaatcaagactaggcttatttatcactgctgaagtggtgctgtctccaggacatttccaccacccttgcttttatatggcaaaaggagcagaaaacaaagttaaaagacagactaccagctaaaaaaaaaaaaaaaaaaacgaatctttgaagcttttattggagaaggaaatggcaacccactccagtattcttgcctggagaatcccagggacaggggagcctgctgggctgcagtttctggggttgcacagagtcggacatgactgcagctacttagcagcagcatgaagcttttactggtggttctttctggcacttgagattaatttagagcaatcatgcattattagtaaaaccaaattatttagtcaattaaaaaataagcttgaggaagagtgaaggtcacttgggtcaccctcctttgctcctctgagaattatccttccaggtgccccaaggcaggggagtctgtgttttgtgttgggataatgatgcccttacttttgagctccaactttccagccaggccctcccaaccctgacccatccccatgtgctttctgctttgctttaccaaagttctcagaaaagacataccttaagtgagactgctggaaacgacttaagagacttttcccaagtggcactgctggtaaagaacctgcctgccagtgcaggagacataagaaccacaggtttgatccctgggttgggaagatcccctggagaaggaaatggctacccactccagtattcttgcctgaagaatcccatgaacagaggagcctggcaggggttgcaaagagtcaaacgtgactgaggcaacttagcacacagcacaagtgagactccaagtgaaaccaggaggccgaccgagaatgtgacacagcgcctaatgagagtcaggagacatgggcgctcataaccggctgggtgatcctgagcacgcctcgacctcccaggggaaatgaatgtgtctccagtatctatggactctcagagaaaacccaccagtgtggctacagaagtcaggatgtagacaaagcattgagcatcgtgcctggtgcagggcaggtgctaaaggagggacagtcgtcgtcatggttgttattcctattgctcttggagaaacaaatgtgggggtgagtgcaggtggagcacagggtggggtacaggtctgagctggtgcactttagaaaacagcctcagctgatgagactagtccagccccggagggctgagactcgggttttgaatttgctgaaggcagctacctaggtaatcatatggaagagaaccatgccaagaaatcagaagcaagccagcaaatactaaagacctttttattatacaaagtgcaggcgctgaaatccgtgcccatgctcgtcagacaattccttccttcctaattatgctagattatcactttaatagtagctagtattttaatatgtatttcagtccctgctctgagcacttgatgtgttattttatttcatcttctcaacaatgccccaaagtaagtactgtttccatttccatgttgcagaggaggaaactgaggcacagagatgttacatgatttgtccagggtcacaaagccggagtcttgacagtcactcaaggatcttgtcaacggacatggtaatctggtttcacaagccaacagggacagcaaagcaaagtgaaggtagcttgcaaaagggacagcagacaccagactttccaaaccagcgtggcctggggacacagtgagtgagtgaaagtgaagtcgatcagtcgtgtccgactctttgcgaccccatggactgcagcctacgaggctcctccgtccatgggattttccaagcaatagtactggagtggattgccatttccttttccaggggatcttcccgatccagggatcgaaccccagtctcccgcattgtagacagatgctttaccttctgagccaccagggaactggaaggaaaactggtctgtgcctgccttgtgttgtatagattacaggacattttcactctatttcacttgacctcgagccaacaaacagagttcatttcaattcggtatcttctgtttaaaaccaaggatgtatgcaatgtaactgagtgatgacagtcttgagaactttctgctttaacagaggaaaaaatgttatccattactctggaattaatttggataaacaatataatacaggtgctggttataatgagtctgacatgtacatggtgatgccattatttgttgatggccagcatccgtttggtattagcatgttatagacacagagctcacgtcttcagaacaaggatgagaaacccatttttagtaaaaccggtcctccgtcatttctagctaagaatggtggcctttcctttcttccttccttccctccctcccttctctgtctctctccttcctttcttctgttgacaaaaatgatcaattaacaatctataatacggatagaaaagacttttatttgagcaaacagaggactataacccagaagacggtctcttagataactctgagaagctgctccaagaagtctggtttcctatcttgtcagagaaggaatatcaaacaagtcggggatacattccttcaggatttaaaaacactaacagatcagcatgtacgcagttgagtcagcatggccttgacacctgggaagggagtcttatcactgaaggagcatcagccttggtgtcccaggaagggaggcatttagtcttcatttttaacatggacattttttttaaacctctggtcagtgtgcccttttctttaagatgtacatgtatgtttgattagaccacaaaggggttggtttagttagcatgaaactcaaattaatgcatgtataagccagaatgtcatgtatggatgtgagagttggactataaagaaagctgagtgcagaagaattgatgcttttggactgtggtgttggagaagattcttgagagtcccttggactgcaaggatatccaaccagtccatcctaaaggacatcagtcctgggtgttcactggaagaactgatgttgaagctgaaactccaatattttggccacctgatgcgaagagttgactcattggaaaagaccctgatgctgggaaagattgacggcaggagaagaagaggacaacagagaatgagatggttagatggcatcactgactcaatggacatgagtttgggtaaactcagggagttggtgatggacagggaggcctggcgtgcggtggttcatggggtcgcatagagtcggacatgactgagcgactgaattgaactgaaggcaggatgactttcttacatctcaatatgtgaacatttctttcatcactttctgtctttcacccagattgaccaactgttagcattttgccacctttccattatcattcattctcctttcttttttctctccaagcctctctcttttgccttccttccctctttcttactccctccctgtgtccctccctcctctatctggctctctctctttttctttcctttgcccctctcccttcctctctcctttcccttgggtgatgactaagcatggagcctggcaaatgaagatgtgcgggaagaggtaggtattgggccacaaagggtctgacttagttgacctagcaaccatgttagatggcacggtctccatctcacctctccaaggcaacccatgaacctcatggactctccagcctattcttccagactcctggtccttcagccgtttccactcccagccccgaggggaagggactccccagcgcccagtctctcctggggcccccctcttggtccagccatcatttattggtcccacccggggcagagaaggctctgtgcggttgtgttttaatggtaatttacaacttgggctgccctcgtgctcaccttcccctcggctcaaggaggtgaacacaatatttccatcttggttgcggcagagaaggggctttctccaagggcgccgtgaattggccatggctgcacccctgacagccgggcagcggggcggggggtgcgggtagcgattatcccacatggataagagccattaacaaaatggagtgtgccatcttcacagcgcaaatattttccctgaccataataccctcttaaggagacctcaagtggcccggccttgtcaccagctcttccggacacaccaccaatcgcttttactgccgctggcgtctgtagagaggaaagggcaagaggaaggcatgccccgagagcgtcccgagagatccgggcccttgtggaccattgtcctctgtgccgaagacaaagggcccccaagcctttctctaacgtgtcgctcaagctccgtcgataaatcagagtccagccagagctattcagacgtggccctgaggagtcccgaagcctctgtgatgcgtttcctttctcggggcgtgcaggagcagggagatttttcagcctcacgcgttttgtttgaattccaccccctccctttttctttgtagcttttctcttttctgtccgtctccgtgtggaacagaagatgcgtttgtaggcctgaatcggggaggggggactgtttccatcatcagaccagtcacacccgcccctgccctgttgtaaaacacagcggccctattgtgcagtgccccataccacccagatttcacctcggccttcgctgagcccccttttttgtttcccgtcaaaagaaagcatttgctcaggggagggaggggtgttcctattgcttccactaacatggaggttaaaggaaagattgatggaagaaagttcacctagaaaaccaggataaatttctggccggccaaggccagttgtttcattgtcctggggccatgttttttgttaattatctctcactctctccttttatcggagggaaaaagtagcagggcaggaagaaaggaacaggatacaggggtcaggggtcccatgggccacctaggtattccatttgaaaggctagggtgggtgaggcggctgagggtgagtctcagtttcggcaggggtgggggttggaggaaagtggtggtcgtcaaattgatcacaaatttaatgccgttatttatggggaaaacttcccaccgctcgccccttgctccggccccctgtaccctttcttcaactctcagggtctttatctcctttccagtcctctgcccattgcccctaaagcacacacacacacacacacacacacacacacacgcacacacacacgcacagatacacacacagaggcacacacatacgcggtttttcttttctaattttaagccccgcaaaactgtaagggaggtttcgcaaagaaggagaaaaaaaagcagcaagagaaagactaagaaagttggtccaaacaagaacatgttgtcaaggaaataaaccttggtgagggtaggcatgaaaccacagctgctgaatttggccagcctcagaccctggtggtaacgacaatgattcttagtggcagggccccagctccgaacataaatagggctcagcctgaaaggggaggaaatgaaacaaaacatttccttgggtaccactggcaaagaaataacatcaatttcagtttagggggaggaggagggaagctaaagcatttccctgtttccccacattagcaaaggcaaattcataactggccaacaaagtacctttgaaatgcagctgcactccacaaacacactgcctttttccacccagagagacaaccctgtcttgactagaaagaaaggagaaagacaaaaaaaaaaaagcacacagtattgaaaacccaccagagagggtaaaggaagaagggaggagagaggggctgggagttgggggcggagagagagaggggaaactcgtggaccttggcagatgcgaaagataagctttacctaatataatgcaacctctttgcctttccaagaggaggcctgtggtgaattgccacacagattctcgggagagggctgcgcacgggcagctgttggcccaaagcagccatgtggccaggaaggaaggcgaccaggcagaccacagctcgaaggtatcaggctcttgggtcccagtgtccccaagggaccaagcagctgctgctcccctgggaatgtctcctgctaggagaccagagccagtgtccctgcagcccagggatgtgtctccatgacagcactttgggatgaagcacaaagatggcattctggactcaggcttccccctcggaccctccaggataagccctgagcaggctaaaccaatctagcttgtacagattagaagactgggtaaaacacgaatgcaaagttagggcacccctctgcgatgcttttccacagaccttgtctcgggacgtccctcggtggtccagtggttaaaagtacaccggaacatggattccatccctggtccaggaactaagatcccacgtgtgctgcaactactgagcccatgctctggagcctgtgccccacagcagtagaagccactgcaacgagaagcctgcatatcgcacctagagagtagaccccactcgccgcaactagagaaagctggtgtgcagcgacaaagacccagcccagcccaacaataaataaataaatgagaatttaaagaaaccaaaaaacccttgtctctcctccaccgccaacgagattctggggaccaaggctgcatctgtatcatgaagtgatctctgactctgccctctcttgtcactctgcttggggactccatacttggggacttggcagcaggggattccctatttccatatcccgggggctggtaacttcactgtagagaagtgactgccaagcaaacgagtcaatcccactgaactacacctaccctccaagtcaagggccccttagccatctcccccaatgttctcagccactccaacaccaacagacacaggggagtgggaaaggggcagagaagaaaaagacagtgatccctgtggattgtggtgaaaacattgaaaagatgcaaattttacaaaatcactaccatgtgaacgagttggtggtagggccttttccaagccttggaagggactgtgcaaatgagggtaataaagctagagccagtaatcaagagacgaatcatgggggcaaggaataacaactctattcagacagccagctagaagcaagaagccagctagccagcaagaagacagtgggctcatgccccaaagaaccatcttgcctgagttagaatttaggttccgtttatactaaaaggggagggaatgaagtcaaacacttactggttcccatcagcgtcctgaggggctgtgttcatttcttcctccccgtggccattcacaggcggacctggtcaggaagtttcttgagagctaaataaaggtacttcagcttaatgttcattaccctggtaaggcagggttcccagcaatgagccactatgtgtaatttaaggcatggaaatcagtgggctgccatgttctgaatcggcccctgacactgatggatcctctccttgaacaagctctttcccagccagaggggcctcgttcacacaattcctctctccgagtgaagggtccactctggcaaatgaccacgcctctctagttcacccttcccagtacttgaccttcccacttgtcccctaacccagccccagggtgcctggaaagactctctcactgaggggtcaccacccacggcacagttcagcagcaagaaagagagggggcggggagaggggggtggaaattcacagccacactggactcagcacgtccaggtccagccatgagcttgtgctgagccgtccaccctgagctctaatagtgaatacaaaccagtcccttcctgttctgatggccctgggctcagttccagcccttcctcctgggtagccctgatggaaggtaggggtgggtctgagttactctctgtgcttcctgctttatacctttccatgactagtacgggtggggccttaaattattgagtctacacgtccttgttctcctgtcctcctagctacaaacaccaagtaccctggctgtgatatggtggggctgggaagggatgcccacccagctgaagcagatttctctctacgagaacaacagtatatttaatagcatgtctactctgagccaggcttcacaggtggcaccagtggtaaagaacctgcctgtcaacgcaggtagacgtaagagacgcaggttcggtccctggtcgggaagatcccctggaggcgggcatggcaacccactccagtattcttgcctggagaatcttgtagacagaggagtctggcgggctgcagatgagagcgtcacagagagtcggacaccaactgaagggactgagcgtgcacgcgatactctaagccactctgtcacggaaatcctaaggcacacttttaagcaggaactgtctttgagttgggctggtcacaaagaattagatgtttaggggtttttcttttaaccacggcatctgcaaagtgcattgacaaatgagttacccatttctgtgtttgcacagtatttcataaaacagggccagggctgctgcaaaatttataaaaggaaccagagactcttgcccctgttattttattttcacccgtttatctttcctctccctattcaagatcacctgagacatagtagaaaaacaaaaccaaacagaaaagccactgtgaaataattggaagtctttgcaagaggtcacagagagtaaaattctttgctgcttaaaattagtgttaggcactgataaaataagttagcattcatttcctttagtcttaatcttttagcaaagtttcaagctttgtgagtatgtgaaggtattcataaaattaaatttgagttttctgactctggggtacctaagtgattctaactctttcagggccgattcctttgttctcagtattgaagcttggagcgttcacagatatttaatgtgcaaaggcatttagcactactaagcaagtatttaatttggcttgctttttctgtcttctttccctttctttatatcctaagtgttattaagtaatcaataaattttgcagctattaatacttataataatactctcgtgagttaatctcaatccattgagactggagaaataaaatacaggaaaatcctataactcaatgctaataagaccatgggggaagcagatatttcattctttagaaactagtacaatgcctttggagggcatttggcaatcaatgcaggtcaaaggtcataaaaatgcttgtactctttgaccctgtcatctcattctttggaatttatttcaatgaagtaatttaaaaggagaaatgataaaataaaatttaaaaaaataataaaataaaataaaaaaaataaaaggagaaatgatgaatgtattgataatttatagcagttttatttatgacagtgaaaaactgaatataataatctaaaaatttaacaataggcaatggataaacaaaacatgaaatgttgatatgatggaatattatctactactgagaatgataaagttgctaagttttttgggccatggaaaagaacaatatcatatctaccgaatgactgaaatgatgttacaatattacttttgtaagtaaaaatccaatgaaaacactgtgtgtgttttgtacattgtgtgtttagtcgctcagtcgtgtccagctatttgcggccccatggactgtagcccaccaggctcctctgtccatgggattctccaggcaagagtactggagtaggttgccagttcctccccaggggatctgcagacccagggatcgagcccacatctcctgcatctcctgcactgcaggcagattctttaccactgccccatatgggaagatgcatgtgaacgtgagtaaatgaaacagttgtcacataggatcgcagaaatatgggccaaaaattcatttaaattgaaagtggctattttttgcattttcacttttgtctaacaagaaacgttagtattattttcagagacactttctttggcacagcttcaattaagcgtttctgttaaccttgctcacctaccgatctgtttatcttaatctttataccttgtgaagtaacttgggttcctagttggaaattaaatgattactttaataaagagactctaatcagaacaaaatagggttggcctttgtgcaaaaaaagctcatcttggatttttttttggctcggctgggtctccgttgccgcatgcgggctttctgtagttgctgcactcccaggcttagctgtcctggggcatgtgggatcttagttccccgaccaaggatcacacccaagtcccctgcattggaaggcagattcttaactcctggaccaccaaggaagtcccctcaaatagctcatgtgtgctcagtggtgtccgattctgattccacgaactatagcctgccaggctcctctgtccgtggggtcttccaggcaagaatactggatcttcccatcccagggattgaaccgaggtctcctgcgttgcaggcagattctttgccatctgagccatcagggaagcccgtatagctcatgaaggatcataaacataggtgaaacgaatgaaatgcattccttctccagccctgcttcttctacatccaaatcacgtgcatcctggccacctgacccccgtggcctcttggaccgtgtggccttcacccaggagagagactgcgggtctcggttttcaatattcccggataagcttattttaaaagcaagaagacccagctaccaaattcaaagcaaacaaacaaaaagcatcaaaatctctctctgttccttcctccctcatcgactgggaatctgtttagagtcggtgggtgaataatgcccactgctctcaaaattcatatttgagttgttctcagaggacaggactgggccttgtgcattgcagtgaaggacactgagcagctttataatacagacagtaccaggctgtgtaggaaaagaaaaggcgtcgcatgttggtgggatatggcttcttgcccccaaactgactatccacccttatcctttgctctgtgcaaggaactgcttgcctcgcagacccagggtctgttctcatcaatcacacgttctgtttgtcctacactggccagttgggtccagcccaccagctgctgtggagacgtctgtgtcggtgcctgcaaagtgggggacacagatgtgtgtgtgtgatggggggacagggccagatgctgctggagacctcatctagccatgtgctcccagccagcctatctgggggaaaaaaaatcgtccacaactttgctccagtaagtggagagttcctactgccttttggttagcagggatatttacatggactttgtggggaaccccaaacaatactggattatctgcctaataaaagctaaaggagtttcacattaattacatttctaaattactaacagtcctttgtccttgggatttcgcaggcaagaacattggagtgggttgccatttccttctccaacacttaacttcagatggtgccaaaatttgtttgaaaactgacaattttaggcaaaaacaacttttaaaagtttgtacatgtcctgcccttttttaaaagttttttttgttgttgttaggaaccacttttagagacttcaatgaattagttacactattgtttctgcttcctgtttggggttctggctgcaaggtatgtgggatcctagctccccaaccaggggtggaacccacactgcctgcgttgaaaggtgaagtcttaaccactggactaccagggaagttcctgtccctggcttcttaatcagttttataaacacaggttcaactttagctgatggcttttcattagaattttaaacttatttattcatatatgaatagccagatttttgtcttatgtaatggtttttctattttttttcccatttttatgctgctgactctcattatcatctattccttcatatagcacctggatctattctttcatattttcagaagaaaaactataccttttatttattcaaaagcagccacatttattgaacccatcagtcaaggacttaggcataatgtgagatcttcaccatgaagacaacacatagaaatcaaatatttatttgactatggccacatggctgggaggtcacagatggaccccactgctcagatctttgctggtcgtgaaggtcgtatagatctaactggctggctagcaacatgctcaataccatgggcctcacccagatctcccagattgcatgttttgtatccaaatagaggaacagatactttatgtgctgtatcactggtctggtacaaatgaaaggtagctatcagagagagagagaatgtaaaaaggttctagcaagataaggatgtatatacaatgtatacattaggttagctgaaaaatgtgttcagatttttcccatgaaatggtacagaaaaacctgaacaaactttttggccaacccaatatatgtacatgaggcttcccaggcagtgcagtggtaaagaactcacctgccaatgcagaagacacaagagatggaggttcagcccctgggtgggaaagatccctggagaagggaatgacaacccactccacttttcttgcctggaaagattccatggcatatggtatggtgtgtgtgtgtatatatgtgtgtgtgtgtgtgtgtgtgttgctaccttttgtacaaatatctatttatttttctagactgggtcctcctctttttcctcttcttcttcttccttctttacctcatcatgatgctagttgggtacccctggtaaataaggataaggccatataaacagatgtgcaagaatcaattctgagactaaacaacaaaataccagtatcctccttttgcagaaccctgagaaagaccattttattatcacaaaatagaaacaaaaaagacacagagagagggaagacatcttttttatttccttctttctttatctgcatttcagacaaggagcttcccaggcctggctccatcagccaccagttggatctccattggggcactgggctcccattttccccatttgtttgttcgtcctctaataattttcctcatccttcatttctaattctaatccagtgagaatatccttattttacaaaagacatacttttacagaagcagaacatattaagaagaggtggcaagagtacacagaagaactatacaaaaaagatctttatgacccagataagcacgatggtgtgatcacttacctagaatcagacgtcttcaaatatgaagtcaagtgggccttaggaaacatctctataaacaaagctggtgtaggtggtggaattccagttgagctatttcaaatcctaaaagatgatgctgtgaaagtgctgcactcaatattcatagcaaatttggaaaactcagcagtggccaaaagactggaaaaaatcagttttcattctaatcccaaagaaagacaatgtcaaagattgttcaaactaccacacagttgcactcagctcacacgctagcaaagtaatgctcaaaattctccaagccaggcttcaacagtatgtgaatcatgaaattccagatgttcaagctggttttagaaaaggcagaggaaccagagatcaaattgccaacatcctttggatcatcaaaaaagcaagagagttccagaaaaacatctatttctgctttattgactacacttagcctttgactctgtggatcacagcagactgtggaaaattcttcaagtatgggaataccagaccacatgacctgcctcttgagaaatctgtatgcaggtcaagaagcaaagttagaaccgggcatggaacaagagactggttccaaattgggaaaggagtacatcaaggctgtatattgtcactctgcttatttaacttctatgcagaatacatcatgcgaaatgccaggctggatgaagcacaagctggaatcaagattgccgggagaaatatcaataacctcagatatgcagatgacaccacccttatggcagaaagcgaagaacaactaaagagcctcttgatgaaagtgaaagaggagaatgaaaaagctggcttaaaactcaacattcgaaaaactaagatcaaggcatccagtctcatcacttcatggcaaataaatggggaaacaatggaaacagtgacagactttattttcttgggctccaaaatcactgcagatggtgagtgcagccatgaaattaaaaaacacttgctttttggaagaaaagctattataaacctagactgcatattaaaaagcagagacattgctttgctgacaaaggtgtctagtcaaagctatggtttttccagtggtcatgtatggatgtgagagttggactataaagaaagctgagcactgaagaactgatgcatttgaactgtggtgttgaggaagactcttaagactcccttggactgcaaggagatccaaccagtgcatcctaaaggaaatcagtcctgaatattcattggaaggactgatgttgaagcttaaactctaataccttggccacctgatgtgaagaactggctcataggaaaagatcctaatgatggaaaagattgaaggcagaagaagagggcaagagaggatgagatggttggatggcaccactgactctatggacatgagtttgaacaagctccaggagttggtgatggacagggaagcctggtgtgctgcagtccatggggtcgcaaagagttggacatgactgatcgactgaactgaacaaaagacaaccaaaaaaaggagaaagctctcctcacagaggagaaattcccaaacaccatttttctgatttgcagattgattttccagttacattctttaggacatctgactacatcagtatctgtgactgccaaagtgtagcattaatcgatcagtctttgaatacactttatttcattacttaggctcacatctttccctcccctggaaattgtatgttattattttcttaagttctttttattttatattatagttcatccagttaacaatgttatgatagtttcaggtgaacagcaaagggactcaaccatacatttacatgtatccattctcccccaaactcacctcccatgcaggctgccacataacatagagcagagttccctatgccatacagtaggtacttgttggttttccattttaaatacagcagtgtgtacatgtctatcccaaactccctaattatcccttcctcccatcctttcccagccaagcagaagttcgttctctaagtctgtgagtctgcttctgttttgtaaataagttcatttgtattatttaatcatattttattcttaagtcacatcaaacacagctgtgactctggggagaaaactaagtcatgctacaataggaagcaagtttccactcctagctcagaaaaccccaaatcacagtgtccagttaccagacaactggtggaggaagtcatgaactcaattagccctttcctggaatgttgggtttccaggaggagtgaatagctatgaggctcctgtgccctccacagagcccaaagttcccactggcatcattttgacatttagctgagtttattgctttggaggacagaaagcactgctgtgaatgtttaagcagaaatgggttatttacatagtctcaaagtatttaataatcacaaaggaagaagtcgtaagtttacagtgaagaacctgacagatagcaccttagccaggtcatctgggtggacacggcaagctgagaaggacacatcagtcaccgtgagtttccctcccaattatgcgtaaccccaatctaatcatgagagcacatcatacaaactcaaatggaggcatgctacggattgaatgtttgtgtctccctgatgttgatgtagatggggaaacagtggaaacagtggctgactttatttttcttggctccaaaatcactgcagatggtaactgcagccatgaaattaaaagacgcttgctccttggaagaaaagttatgaccaacctacatagcatattaaaaagcagagacattactttgccaacaaaggtccatctagtcagagctatggtttttccagttgtcatgtatggatgtgagagttggactataaagaaagctgagcactgaagaattgatgctgttgaactgtggtgttggagaagacactttagagtcccatggactgcaaggacatccaaccagtccatccttaaaggaaatcagccctgaatattcattggaaggactgatgctaaagctaaaactccaatactttgtccacctgatgtgaagaactgactcactggaaaagaccctgatgctgggaaagactgaaggctgtataagaaggggacggcaaaggatgagatggttggatggcatcactgactcaatggacatgagtttgagcaaactccaggagttggtgatggacagggaggcctggcgtgctgcagtccatagagttgcaaagagtcagacacaactgagtgactgaactgaactgacggtgatacatcgaagccctagccccccatgtgatggcatttggaggtgggacctttgaggtgattaggtcatgagggtggtgccctcatgagattggtgccctctaagaagggctatgaaagagatgatatccctctcaacatatgaggatataagaggaaggtgggtgacttttaaccagaagtgggtcctcaccaagaacttctagcctccagatctgtgtgagaaatagaggtctgttgtgtaaaccacccaatttatggtactttgttagagccgcccagactaaaataggggcattctataaaatgactgactggtactcttcaaaagggttgaggtcacgaaatcaaggaaagagtatggaactaccatagattggagaaggctaggaagacacgatgattaaatgtaacgtggtaccctgaaccagaccttgggactgaagaaggacgtaagtgaaaaacagatgatatgataagttctgtaccttagagaataatatcatgcggagattaattttttaaattttgataatcgttctaagattatgtcaaatgctaaagggaaactgagtatgaagcatacaggaccctctggactatttttgcaaatcttttgtgcattcctgcatgctaagtcgcttcagtcgtgtccaactctttgcgaccctgtggactatagccctccaagctcctctgtccatggaattctccaggcaagaatactgcagtgggttgccatgccctcctccaggggatcttcccaatccagggatagaacttgcttctcttccgtctcctgcattggcaggcaggttctttaccactagtgccacctgggaagtccactcttctgtgagtataacatcatttttaaagaaatgcttctgtgactcaaaatggccaagtgctactggaaatgtcgatcagcattttgggaagcaagtgaacaaaactacattgcttttatgagaaagaaaatcgcttcttttatggagaagctgccaagaaaccttaacgaatattagacgggcttagagtcctcagtgtgggaaagaaactgataaattatccagaatgctaaggagattatcaatgggttttactctccgagcctgtatacatctccctgttcattagaagtaataaagatgtgcaggttgaaaccagagttcgtcttaatttactattcctgctttgtttattatcctgtaaaacttccaaaagcttggctttacctttaattctatagcaagaaccaaattgaagtaatcaaatcaagctactcttattatgtaaagctattttcttggacccctgctttgagtaaatgattcctattaacatgcagatttgctggggattaccagaaagtctctcaaaataatcattagaagatgtctttctaaagaatacttttctcgctctgacttggaccaggattcagcctggtaaatctctcccgtcttctgctcagggaccatttgggactactccgtgaccaggatgggaaaatggggacttctaattcacagattggaacaaaaaatgaaaatacagacctggcttcctccccctgcattcggctgacttcaaagtcctgtcacagcccagctgtagggaagaaattcaggagtatgagtataaacgctgtatgtgtgtgtgtgtgtgtgtgtgtgtgtgtggcgacggcaggaggaaggtgtgaattttctgccacacttctgtttgactgcactaagtacagaatctcacacaatggagagcgagaggctgtatagcgctgaggtcgaggagagagggctcagcagtcagactggggtttgaggcatcatgtccctgctgctgattgtcagcgtgttacttaaacctctgtgctcttagctctgaaaaggatgttggttatatctttatggtggttgtcaaaattaaatgagcaggacttccctggtgggccagtggtaaagaatccgcctgccagggcaggggatatgagttcagtcgctggtccaggaagactccacatactgtggagcaagtaagcctgtgagctgcaactaccgagcctgcgccctggagtccaccagccgcaactcttgaagcctgtgccccccaacaagagaagcttgtgtatcgcagcgagagaaggcctgagcacagcaaggcaggcccagggaggcaaaaagaaaaacaaaatttaaaaaaagattaaacgagcaaatccatgtaagagctaattgtggaaggatgactgttgaaacctgggcttccctagtggctcaacagtaaagaatctgcctgcgatgcaggagacttgcagggatctctgggtcaggaatagcctccagagcaagaaatggcacccactccagtattctcgtgatgggaaatcccttggacagaggagcctggcctactacagtcatggggtcacaaagagttgttagttgagtaactaaacaacaacactgaaagctaagaaacttcccattagttgaaaagtgtgtgtatatataaatatatgcaaatcatacatgaatacacacaaacatatacgtgtatatagattttggattggccaaaattttcattcgggtttttccataagatgttatggaaagctcaaacactttggccaaccctatgtagctacatatatatgtgcatacatatataaccttcagtgtatttatttataattggggaaaactataagaaatctcagtgctgcatgatagcagaatgtgccacctcaaaagatgactaggagttcaggacatgtcaccctaaaatatactgctttggtgtgctgattattttgagctgtaggtgttactgaaccaaacttggttctgctcaccccacatacagcaatgcccatctactgatgctgggctgtggtgaaggaaagtacagtgtttattgccaggcactcagcaagggagaggggggaaagcttcagatccactcccacttggtctctgagcttttttctttttttttttttttttaccaaaggagaagcacaaaagctgggattagtcattgcctgtgacattttttaattgtaatttgggagtcgggttgtttagaattctcaggttaggtggcccacggctcgggggtctgcgagctcttcttgttctggagaaacaacctgagtgtgtactttcatgatgagatctacactaacagttttagtacatgaaccatgttattggcaagagcaattttagccacctggctctggttgattagtgttcagttagtacacgattgcaggtggcagtactggtaaagaatctgcctgccaatgcaggagacataagagatacaggtttgatccctgagtcaggaagatcccctggaggaggaaatggcaacccactccagtattcttgcctggacaatcccatggacagaggagcttgatgagctacagtccacaggtttgcattgcatcagacacaactgaagtgactaggcacccgtgcacggaagcacacgaccgaggtcagagaggacaagaaagggaatacagttatggaaagagataaatcataatcagagtgaggggattggatttgagggggactttgttttagaagcacttgataaacagcaaatgcaggaagaggctttctctgaactcactctttttatctggacagatcctccaaaaggaacacaacatatcagtctcttcctttgggttttcatcaaccagagataactgactcaccacaggagagaccggaagtcaggaccacacccagacaaactctgtcacaaataacctactctctactctctcttttaagaaccccttcatctttcctaaaaaccacttactgtcccctaaaaggctgccctccctcctcctttatccttattaaggtgtcatttaatcctgaatcctaagccacctggggagtgactcatttttccctcatatctctcaagaatcatgagatagactcaagaatgaacttctgtttgcttttctcttgtcatgctgtctttccttacagaagcctcagctaacaactgagaaaggtagaagggaattatttttccttctttagaatgcccatcgataaggaagtggttcagtgatgataaatccactcaataaagtattatgcaccagcaagataactgcttggaagactctggagctgcctggcaatgttcagggggaaaggagatcacaagttattatgcaccatataattataactataaaattataaatgcatgtgggccaacaaattagagggaatacagaaacattaaaatggtcgtatttcgattgcattaaaatggcctctattttccagctttttaaaaatgattttatctactcatccacttaattttggctgtgctgggtctttgttgctgcgagggcatttctctagttgcagtgagtgagggctactctctagttgcattgccaggacttctcactgcagtggcttctcttgctggggagcagggctctagggcatccaggcttcgataattgcagcatatgggcccagtagttacagttcccaggctctagagcacaggctcaataattgtggtgcccaggcttagttgttccgcagcatttggggtcttcccaatcagtgttggaacccgtgtctcctgcattggcaggtagattctttaccacggagccaccaagaaagcccccttcagctttttataatgatttaagttttcttttcaaaaatgaaaaccttgtaagtaaaataacactaggaaatcaagaatttagtggctgcttctaccagaatattcttttttttttttggctctctcccttccttctgtgccctgggttctgatcccatctgaaagtgacccatgagtattattcaaagatccctcccctcccagtaccctcacaggaaggtgtctgactgccaaggaaactgtgtacagctgggatctggaccaaagattttattcaaaatttggggaaggtgttcctacttgccccccacctcgccaaccctgcacctgaacccttttttggtttgattcagtttctctaccattgacataaatatttgggcccattttatttacaaaacggacttcccaacaggcaaattttggcactgatttatttaaaatagtaagttgtaaaattaagtataaaactcataaagaagacataataccatacattttatttgcatagctatgcattgtaatcgatgcttcgtctttctccttgtctagtgattgctgtgctaccttcccggatggacgtatgtgctgtagattttgaggttgggtgcagatgcaaatgaaaatgcattttaagatgtagggattactacaacaaccaagaaaatggactttttaattaagttttaaagtcagcaattctatctttgaaaaatatccttttaaagaataataatgcaatatttagacaaggtcagagtgggagcaagtaggtctagagaaaatgtagtgttcttctcaattttgccaaagttctaatcaaatgtaggagtaagtggcaattgtcttttaaccccctttccccaccaggagcaatagtttgtcactaaggaaaatcacagttgcccagatttgggattgagatgttgtcttagatcctgagcaagtctctgctgtttagagccccagcacagccagagtccctagggaaggggttgtagacttttcctctgctggtccttgactttgcccaaggtgatggtcagccactttaatatgaatccctgtccgctcccaccctcttcctccaaaaaactccaagaatcattttgacaacctatggaggtagttttcacttcctgcttatttttttttaaatgtcatgagatattaaggaagaaaggagtctagaggcagcctacttgtctataaagatcaagggcaggaacaggttttattcatttccgtttctccatgatgtagtgcaggggtccccaacctcctggccagggactagtacctcctgatcaaatcagcagtggcattagattggaaataaagtgcacaataaatgtaatacatttgaatcatccccaaaccatccccctcttccatgacaaattatcttccatgaaactgctccctggagccaaaaagcttggggacggcaggtggccagtgcaatgtctgattaaaagaaacaatcgtaaaacaaaaacagctaatagttactgaattctccctctgtgtccagccctctttacatgctcatcaactcacttggtccttaaagtcattcttaagtaggtactgtgataactctccttatagtggtaaaggaactgaggttcagagaggtatgtcacttgtccaaagacacccagccagagctagagttcaggtcttgaggtcaaatcctgttcccttaaccacctggtcacactgcttcggagcacaaagtaggtgctcaacagatgctggcaggctgaataaaagaatgcctgaaagatacctgtgctgttgtcttggcattagaggcgagttctcagtctaggttgtgaaagaaactcaggcttaggtgatctcatcctaaagctacccttccttctttgccaaaactggtcttagcctttcaggctccagattttcccagtgagatgctcagggtaaggactggggtggtgcaaacccccaggctgggaggatgcccacgttccctcaggtggagtcgaggacaattcaactgttcctttccctgcctgggttactgggagcaaccttgaaatcaaagggaataagaaggaaatattctgcagatgcaagcagatgcttcatcagcaagtttcagaaatagaagatggctcccttaagcacaatcagtgggcagattattttcttgaagtttgggtgccgttcctttggattgagaactttgcctgtaatctcaagacttcagttctcagtaaagaaaacaagacccagactgatacattcacacattggtaaaaactcaaagcccccaaacaaataacaccttatgttccaagatgcatatgaaagcattaaaactaaacaagatttttaaggagcctccatactgttctcctccatactgttctccacagggactatatcaatttatattcccaccaacagagtgttcccttttcaccacatcctttgccgcatttattgtagatttctttttgatgatggctattctgacccgtgtgaggcagcaccttattgtaattttgatttgcatttctctaataattaatgctgttgagcatcttttcatgtgcctcttgtccatctgtgtgtcttctttggagatgtgtctgtgatgacctagagggatgggatggggaaggtaggagggaggtcaggagggatgggatatatgaatacatatagctgattcacttcattgtacagcagagatgaaagcaatattgtaaagccacaataccccaactttaaaaaaaatgaccaagaagtatacaagcaaatatgaaagttggaagaggaatggaatgggagcagtgagaacagagtcttccttaaaaaaaaaaaaaaaacacactgaaaacaaatttgaaaatacgttaactgttgtgaattctggatgtttagatgttattctgtggactttttggtgtctttaaaattttcaaaataaaaaagacaaggtgggctgatttacgtaattccccaaaccaaacaaaaggacctaagctggattttagcagctgatgctatcagtggcctccaagtgaggcagtatgcactcaatagcagtcctagagaagaggaggtgggtgatatgtggcagggaggtatacaccccaaagaggaagatcctagatttggaggaacgtccattctagagcagtgtttttcaaacttttttaaattttagtttagattaagccatgaaattaaaagatgcttactccttggaaggaaaattatgaccaacctagacagcatattaaaaagcagagacattactttgtcagcaaaagtccatctagtcaaggctatggtttttccagtaatcatgtatggatgtgagagttggactataaagaaagctgagtgcagaagaattgatgcttttgaattgtggtgttggagaagactcttgagagtcccttggactgcaaggagatccaaccagtccatcttaaaggaaatcagtcctgggtgttcattggaaggactgatgttgaagctgaaactccaatattttggccacctgatgcgaagagctggctcatttgaaaagaccctgatgctgggaaagattgaaggcaggaggagaaggggacaacagaggatgagatggtcatgtccaccgactcaacggacatgagtttgggtaactcagggagttggtgatggacagggaggcctggcgtgctgcagtccatggggtcgaaaagagtcagacacgactgagcgactgaactgaactgaaatttatattcacacatatatacatttgttcctgaaataaaatttcaccaaactcacctagctatctattatgtagtctattttttaaaatgctagtcaagacccattaaactgatctcatgatatgtgagtggttagtgatgcccaatttgaagagtatccaaggatgacctttaaggcactgggagggcaacttctctgtgcctcttttcagaccacttcctctcctctcccctcctacccctgcctgacattgatctacccattcttcacgtttctggtccaattggaaatgagaagcaatgtgtggggctcctgggcacagaagcctctccaagcactctgtttcttatttgcagggaatagtttccaacctccatgaccttccctgaattccaaagggcaggtctgaacagttgctgatcagagaaggggaatgtggggcgatgctgagacaagggaggagcagccaagaaacaatagtgcagccttggggcagggttctggttccttctcaaggcacacgcacagcagtgtatcttccagctctttaaagaatgaaacccccccaacagatggaagatgacagcattcttcattccagataggaccacctgggagcagactgtcattcagttctcacgtccaactctttgcaaccaaatggactacagcgtgccaggcttccctgtccttcaccatctcctggagctcgctcaaactcatgtccattgagttgataatgtcatccaaccatttcatcctctgttgtccccttctcctcccgcccttaatctttcccagcgtcaaggccttttccagtgagtcagctcttcgcatcaggtggtcatagtattggagcttcagcttcagcatcaatccttccaatgaatattcagggctgatctcctccaggattgactggtttgatttacttgcaccccaaggaactctcaagagtcttctccactcttcttccaaaccaacttctgttttcatggcacttactcaagaccaggaggaaatgcaaaacaaagaaataattacatagctctgtgaggtggtgacccttgctggaaaacttaaacaactgctcttgatataaaagctggcttctgcctcatcatgtacccagagatccaaggggctatctagggcatccctcttaaatctgaggaaagctccaaagggaaaaatgaagacaaaatgaacaaagataagcccagagaaaaaagagacaattcagtacttttcttactaagtagacattgttgtaataaaactgtgacttttccagaaatacaaaagaagttattcattcatgaaacaagaacaggaagatataaaaatagatcagtcagagaatgacagtttttgaaaattaaaatagaataactgaattaaaaatataatttaagaaagtgttgaaaaatataaccaaggaaatctcctagaagcataccatctggaaatatggaagtaaattccagaagaagaaaaccccagatgaaatagttgaaattccttgcagggccattaaagtgagattccagaagtgggaacaaaacattgtgttcattctttataattcatttaagtgctatttgattttcaaatgagagaatatatattggtaaaaatgagttatctttttacagtgctgacaatatttttcaagattctagaaacatataataaaaaatttaatatatccttaagttaaacatacacttactgtatatgctttagggactcactatgactaagtgacactgaagattaaaaattttaatttgattctcaaagtgaatgagagcctagaatgatacaaaatttagttacttttcataaaagatagaatgtagtctaattcggttggccagtgggtgaggggctagctggtgccctctgtgtcgcagattgcatgcccttggacagtcaagaatctattcaggaatctaagcttttatttcctaatgaccttttcagactcctgcattgttctcactggggttacacaagaccctgccccaataggtttctcaccacagatctcctttaagagacacaaagattacatgaccaaaaataccttataccagaaagaaggcaatggttggtgaaatatctgagtcctgattaatatcaggaggaaaggacactctttggacttcttcatcttatgtcagcaaatggagtgggggtgggaggaagaggcacagcacacacacagaggagggtcagagcagcatgatttagggtcgctgttttctcacacttacttccatttcttctctctggagaagtaagaggctgaatgagttagtctctggattgtcttgaacctctaaggattcgccactacttgcagggtgctggctgatttgggtgcttccccatgcacatctcagtcctatttgggcagatgaaagtcccagaaagtgggaggctgccaagaaaacagtgcagagaataatgtctcttgtggctgtaggaaaagcatcttgtgtcctggtaatgctttaaaggcctcttgagtttccctgaactcccctacatttcctgatgtgtgaacagtcttcaggaaacagttcttttaaagccatggtccagcaacagaggaatagataaagaagatgtagcacatacacacaatggaatattactcagccacaaaaaggaacaaaattgtgccttttgcagagacatagatagacccagaaactgtcatacagagtgaagtaagtcaggaagagaaaaacaaatatcatatattaacacatagtatgtggcatctagaaaaaaggtacagttcagttcagttcagtcgctcggtcgtgtccgactctttgcgaccccatgaactgcatcatagcaggcctccctgtccatcaccaactctcagagtttactcaaacttgcgtccattgagaaaaacagtacagatgaacctatttgcaaagaagaaatagagacacagatgtagagaacaaatgtatggataccaaggggggaggtgaaggtgggatggattgggagattgggattgacacatatacacgaccatgtataaaatagataacttctgagaacctgctgtacagcacaggaaactctagtcagtgctctgtggggacctaaatgggaaggaaatccaaaaagggggatatatgcatacatacggctgattcactttgctgtacagcagaaactgacacaacatcgtaaagcaactatacactaacaaaaatttttttgaaaaaatttattaaaaaaataaacaatattgcttcatgggaatctgcctccccaattctgcacacgcctgatatgcaatgttaacaaatgctggagaagacactcaatgatacaaaatttagttatgattgataacagcaattataataatgacaataacaagagctagttatttctaaaactttattttgtactggggaatagccaattaacaatattgtgatagtttcaggtggacagcaaagagacccagccatacatgtacatatatccattccctcccaaactctcctcccatctaggctgccacatatcactgagcagcgttccatctcctatacagtaggtccttgttggttatcccttttaaatatagcagtgtgtccatgtccatcccaaactccctaactatcccttccccacatcctccccccagcaaccataagtttgttctctaaatctatggctctctttctgttgttttgtaagctcatttgtatcatttctttttaggttccacatataaacgatgtcattcaatatttctctttctctgacttacttcactgagtatgacaatctctaggtccatccatgttgctggaaatggctttatttcattttttttaatggctgagtagtactccatcatatacgtgtaccacatcttctttatccattcacaagagctagtttttagtgagcactttccatgtgcccagctttctcctatgtgatgctagctgagattctctgtgtccatatccttttggggtaaagctagatttcaccttatcaaagaaatggaatggctttttggtacataagtcatcatctgctgacaaacttgactcgattacagtctttttttgtccaaacagattcttaaaacaattgaacacagtatgggttcctctgttcctcccatattctaccccaaaatagtgattaagccctaatctgaaattattcaaggattcaacttcctgccaaaagactcaactttccagctttatttgagttgctttcctgccttgtagaaatgtactgcaatggagtcactttgcaagaaacttacataccagagtattttgccccaaatggtcacatgattccttacactcaataccacactagtgctgaacgctccttggaaatgtggcacctgaggaaagatttgatcaatggatgatgacacaaagtcctcactgctttctttctcctcttatctgaccaaactgctgcttgtataagagcaaagttaggaataagaaggcataatcaagttctcctagttaacaactctgataaaagaacaaggaagaaaaaataataatgaccattggtttggggattttctggggcttgaagttacccaaaacttctgctttcagaggcagcagagaataggattgcatatatggttgggcaggttgttcattgcacgagagtcctggacaaaggaggtaagcagagactgaaatctagtctgcagcttgcttggctactctctgcacggggctgaatcccccatagctcccacgtagccatttcatgggctagcagtggtccccattaaaggcatattccacgattcagttttgtggattagcatatggaggtggggaggtgggggaaggaaggctgatggggaaaaaagaggaatcatgaaaaatgtgttgccattggggagggggttgtggctaaagaccaagaccaagtcaagacatggcgtgacaccgtgtttattggctcccaccaatccaatgacttagttcagtaggaggcatctgacggagctgagaaatcttaacactgagatgggctattttccaaacatttcctgagtggcagggagtgttctgtccccctgggacacattttccaagaaaacttccaaagttttcttcttcccaagagttttagtccacatgagttttcctctgtccctttttatcctgccatcgaggccgggctcccccatcatagtgggtatggcacaccattccttcctggggttaacggcccatggtggtgctctggagatggcaatttgtaatgtaaagagcctgaattgtttgtttaacagtcaagtgacaaattatttaattagcacatatgccatttgtctccacagctgtgatcatcggtactaattgcaaagcagtcttaatttattgtagatatattgctccatgatgctaatgtggtcattaccaatggccattatgccctgtatcatgtttggaaatgagagcgattccgccacatggggaaaaccacacttctcgttctggccaatacaggcagccattcctgcctccagcccctgaaggattcaaaagagcagcgctcctttggaaatctttccagctgcacttctgaggatcagagcttggaccaggggagcctgtacctgcttccacctgcccaccggcagacaaagtacaacgtggacccaggccatggccagccaagagatctgccttccctgtcctgcccacccaccacttgcagaggagagctcctccttcccgctatctttaatcagatatgtgtcacagtcccgcaaaggggagcctcagagcagagtgctcatctcagggcaaatcctggaagcagcctattaacagacaccaggaacttccctggtgatccagtggttaagactccaagcatccaatacagaggacactggttcaatcctaggtcacacatactacacaccacagccgaataaataaataagaaacaaacaaacaccagtaaccaaaatagcaatctaatacctgggcaaacaggagctgtagccacgattgctgctgcaggtggcagacttgacaggggtaggggcagggcaggtgaagaggatgcatattctcaactggggaagaagtggctttatccccaaatctcccattaagtgtgggatctgcctctgggaagttcggtttaaaaacgtggtcccaataaaatgatgcccaaatccacttgaggagatgccgtggagagcaggaagtaaggacaacctctctctgtccagcagccctggtgttgtctcctagtttaagctggaagttagaggagagtctttttgcacagctggggcatgggaaccacatgttcaccagccaggctaattagccatctttctggaaagcagctacccatctattttctcattatcctcttaacactctgggttgcaggccgaggaggctgcctccctgacaggtgagggggcgggggtggggagtaggagggagtggccagctccggggccccagaggggaagggatagggttgccagacaaaatacaggacatccagctaaatgtgggtttctgacaaacctcacaccactttttagtatccattctttacctgcagtccagattcaactgggcatccttctttatttgctccgcctggcattcctggatgagaaggggacggaggagaggacaaaggacatgcctttcttcctaaattctctgtttggggtaggggaccccgcctgcctccagccacaaaccccacaggagaaacctcgaagctgaggtcctcctgagagaccgctgtagacacctggcagttgagctggcaacccggaagcatttcccagggccctttgagactcccggaaatgcttccttgtgaagcctgcgcctctccccttctgccgccatgtcagggtcggcgggcaggagcctgctttcctgggcgtatttccccagtcactatctcagataaaaggctttattaaatcaggcaaacgtcaatcccactgctcaggaataagttaaccagacgacaggggtgggcagataaaagtcccctggtggttagcatcagcataaagaggcccagggagggtgcaggcggtggggccactagccaggccctggccctactttgcaggtgaccactggtcagagctccgtcagctgtgcctggcccctagacggcaaattaaaaacagcaaatgtagctctattcttttttttttttcctccctacccctccaacccacacttcccaccccctcttttgccccttttttcctttcttttttcttttttgtcaatgcggaatacaaggccactgccaaaaacatatcccacacaatcaaacatcagatggtgactcctttcccacagcttgtgtgagtgaaaacagtgaaattatacccatgttttagcggcgaatcccctggtgttctagtggagaccggccccgctctggctcttgttcgctgctttttgttcctgccttcgcagtgtttttagcgctggacaccattcagcctgcattcagcattgtatgtcacttcacatatggttcatccgctccaaatgtgtgcatgtacccagaaaatgcagcttttcattatgtattctctatgtaacagaaaagattaagatataagcctggtgaatgcggcaggaattagttggacagatgaataagggaaaaatgaatctagaatgatggtggatttggtctaatgattgtgggagggcggtaagaacttgctggtaggtttcagcccttttaatcccaggctgtgtgtattttggcaggagaaatgcttcctcagaactccatctcgaagggtacagtaagaggcacaggcgtgcgcacacacagacacaaaccactttaacctgagcggatgaacaggttccatgaggagaccaggccctcggtcctaaaagtctttctgcgaagtacaggattcggtatttcaacattcagctttaaaaacaaattaaagggggaggccttcttggtaatgatgacacttttacttttgtttccattttatttgtttagactgaaagaaaggattcgggcccagaaaggccaactctctaaaatggatttgattttgaacagtcaacaaaagcaaaaaatgttcttaggtgctatttacatccgcacccaaattagaaaaaggggtgagggagaaaaagactttagtcatttaaagtgcataaacttggtgtctttggagactaacactagtcagttagaagccttggttgacacagtagagttttccatcagcatttgctaaaaagatgcttgtgttttgtatcattgttttctggcttaataggaagccaggagggagaaaattgagatttaggcttacttatctcctaccatggtttccagagaaagatttttttttttgctccagccaattttgattgaaaatcaagatttgcatcacaatagagatatttcaaaagtgtaaatacaaaaggctacaacttcagagacctcttggtcacatgtgttggcctctggcgcgtctcataaagtcactgggaaggggctgttttctgagtccacccagagaagactctgcttgctgaaaaatgcacacacaggctcttctggaaactcatatgtaactatttcatgtgggggagaggagcatagcaacacttcagcttttgaggaccccctatttatggaatttaattcacagatatttttggtgggtggaaagagagcactgtaggccctttgattaattcacacaagaaataagccttctagagtttaacaaaatcagacaaaagctatttttttgtgttgtcatacaatgtctatgttttggtattccttgcgtcattgtgggccagatatttgagaaattcctttatttgggtgaaaaaatatacacacggccaaaccacatttaacgaaggagaagtagcatcttttaatttaaatgacttttcattaaaattgacttcatttttccccatgatgtgatcagcatttagtgatttagctatctggtttatattactctcatagaaatgttaacagtttcagagtttctttccctaactaaaaatgccagattttcccagttttttttcccctttcctatcatattttcacacgcatgtgacaactatcatcaaagcaaaaaaagaaaaaaattacttgaggctgcaagttctgtttttccttgcctagcccaggatttggacacagtgaaaaacaaaacacatggcatcaattaaaaatatcattcaacttttgtaccatttttagataagttggtgtcttttagtaatgccttaggggaaaaaaatgctgatgtgtgtcctgttttcttattttatgtaaaacttgacctactggagctattttcctcctgggcatttgtttggaaagtaacgaccttgcatggatccagcaggacaaacaggactaaaacctcgttcctgcatcttggtttagttgtttattttcatacaattcctgttatatcctttctttctggtccctaaaaagacacccagggaagcttcaaacctttccttcagcttagataacctggtatccttttccacaacactttttctttttttttccacaatgggaagtgtttccatatgaaacagtttactttttctgttaataataagcacgcagtctcttttttaatctcagaaaattttattgcgttttagaatctccacacacatgctggggttgccgtaaacaatccgggaaaactgctgttggcagaaaacttagatcataatttgcctgacagaacaaaacgccttctggctttgtcctcgtgtatgttggggggttattatcagtgtcgtggctttctgtgctaaatacagggctggaccgtggaaaatcaaaaaacaaactggcattcgcaagggcaataacttctctcgaacatgggaggaatctaccagtcgcctattattccggatttacttctgcttctctacgtcttccagggtaacagatgaagatgggtcacccaccttcagccttgcagtgtaagaaagcaacagaagacttctctccaggaattagaaaaggaaacctgtttgcttttcaagtctccagtccctcccatagagacaaaagggaaattagagtgagttacctctgtggaattgccaaagtgaaaaacggggttgctttatccaggctcttcagagctctttaaggcttgaaggtctggattgaagtccgtataatactttcattcactaagtcaagattaatagcgctggtgttgtgtccttgggggagaacctatttccagaaggcatttggaaatagagattgtcttgctttgaatcatttcctccggagcacacatcagaaaaatggattttatttccccagaacaaatttttttggcacctgatttaaattcactaaattgtttcccccatagaaccacgtttccccacctctcatctttgtctcagataccgctgttttttactgtctctcctgtcctcagtataacactttcaaaaacagttactgagtaatattttgccctcccttctaagtcactttattttgtatgtgtgtgtttcctgaactgaagaatttcatctcttttttttttaattggagtataggtgatctacaatgttgtgttagtttctgctgtacagcaaagcgaatcagttgtatgtatacatatatccactctttttagactcttttcccatctaggccattacagagtactgagcagagttccctgtgctatatagtaggtccttattagctatctattttatacttagcagcagcagcatgtatatgtcaatcccaatctaccagtttctctctccctcccttcccccttggtaaccataagtttgttttctacacctgtgacttgatttctgctttgtaactaagtttgttcatttattttataaggataaataagtttctttctgtgtttttttttttgttgttgttgtttttttagatttcaaatataagcaatactgtatgatctttgtctttccctgtctgttaaagtcaccatatttttaagcttcaagctcatccttctatgatacccccaaggtttccattacaatatctgagatagccatattttggaccagaaataaaatctaagtttcttttcaaacatgttttaaaataaaattggaggggaatcacttggaaataaaaccaatttgatgtaagttctcagcacaaatgagatttcatttgctttctgctttgccctagagaacagaatgaaagaagaaaagtgaaaacagaacccaaacagttgctgagtgaagaaggcaggaaggcgaagaagaaattggctttgaaatttaagttctgacccttacactgctgcagatatcccaagcctgacagcttctccgagactcttacaggaacctcccaagtaaaatgtcagaaatttgttttccttttgctgactttcactttttctctgcatctgcatgtggttcagtgttagtggttcctgtttgcacactgggaagattttactttgaaaaaaccaaaacccaaagagacctccattcacctcatctggagccacagggtgggccgtgcaggtttcagcaccggctgtgcactgggacgtaaatcttgaggaaacagcctaatccctcacaagcccccactgcaaattctgtccctggcattgtttcctaaccagctcttgtgagtaccatattgatcctaaaaactggcagcttctcagcttacaagtgttccctttatggagtacggagagccaagccacggagcaggtattacatcttaaggcaaagacaaggatcaagtggacctcttggacggacgtttcctggtgtgtgtgctcattattgtctgttggtttagtgtgtctgtcggctgttttactggcgtctgattaatcctcctggtcaccaggggtaaagccagagtttcatctgatctaggaacaaaacttctcctctcttggaaagaaggtggtctgtccaggtcagggtatgggtcattggaagggcagccttagggagcctgctgttttcacagcaaccacttgttatgattagtttcatatattaaaaaaaaagaaaaagctaacatgcagtgaattgacacttttgtgggtcccttggtctggacggtgcaattgttctggaaaacaatgtcagcattttcgtttgaaagtggagagtacaaccccatttcaagcagcaaaaatcactgcttgaaaaaggaaggtttcctttccttcagtgtctagaactctagtctcccgctccgtactaaatccaaatatatgaaatgaaaatgcaggaatgaaggagggttaaatcgagcaagacggcagcagcacacactgccccagccagctccccagcagggctgacatatcatttgtagaattgcaattgggagcagattccttgagtcttgggaaagatttcccttgggttctgatagagaagtctagacaccctgcaacgtcccttctattctggtcccttttcgagtgaaaaaaagtgaagtcgttcagttgtgtccgactctgcgaccccatgaactatagtctaccaggctcctccatgcatggaattttccaggcaagagtactagagtcggttgccatttccttctccaggggatcgtcccaacccagggatcaaacctgggtctcccacatagcaggcagacactttactgtctgagccaccagggaaaccctccctttgcaatggagacagcaattcatagctgggtacatatcagcctggaaaaacaccaccatatttaacagaattgctcacagccaagtgtgatcttgtgactaagttccagctaaggctgaaggtagaaatggtgtacaacttccagaaagagtccttaaaggaagggaaattcccttctttgctctcctttatttcctgctgactggaatgcagatgaaatggctgaatgcctcacactctatgaatttgtgataaggaggcaaagcagccccccatgaccaagaaaacagagacatcccaccacctctggacacatgagagagaggtaatctcaggtctttttcaagccactttaatttggaggccttggtttcacacagatgaacttataatttctaacaaatgcaggcacgcagggaattctctgttctgccaagtccagatcaaagtttgataacgtgcgtttcaatctgaatctctggactcaactggaaaggcaaaatgaaaagataaatgggttccaagggaatccagccccaggtgacaagttgtctgggtcagaaagctcttgtgagcaaaagctgctccttgttctgttgttgttcagtcgctaagtcgtgtcggactctttgtgaccccatggactgtagcccaccaggtccctctgcctatgggatttaccaggcaagaatatagcagtgggttgctgtttcttttcttcccagcccagagattgatacttggcaggcgaattctttaccactgagccacctgggaagctcagagttgtccctacaggaagccaaatcacccaggaacactggtctctcaggtggatagttgtatagataaagaaaattgattctcaattgtttttttattttctgctatttttgtagctttgtgctacttctttatctggttacaccaaccctagagatactaataagggagatgcttcaaacacctttggacaaaaataagtaataaataacaaaggggagaggtctccaaaggtaaatgccaaatggtgaatattttcaacttcactaattttcttttgtgaaatggaaaggacatgcattcaagagttttgcttccaatgtcatgttttctaccacaataaaaacaaggctttcactggtgaaaagaacatgtataaaccactgaatcaatgagcacacctacatgcaacaacaatggacttctacgtacaaaagaatgaagctggaccccacctcacaccatacataacactcaattcaaaatggatttatcaacctaaatatgagataaaatagagaactcttagaagaaaatacaggggtaaatccttgtggcctcggattagacaatgacttcttaaacatgacaccaaaagcacaaacaacagaaggaaaaaatagacatgttggactacatcaaaatttaaaacttttgtgtgacatatgttgccttcaagaaagtgaagagacagcctccagattgggagagaatatttgcaaatcatttgtctgagaagggaagtatccagaaggcataaagaactcttcagttcagttcagtcgcttagtcgtatctgactctttgcgaccccatggactgcagcacaccaggcctccctgtccatcaccaattcccagagtttatccaaactcacgtccatcgagttgatgatgtcatccaaccatctcatcctctgttgtccccttctcctcccaccctcaatctttcccagcatcagggtcttttcaaatgagtcagttcttcacatcaggcagccaaagcattggagtttcagcttcagcatcagtccttccaatgaatatcaagactgatttcctttaggatggattggttggatctccttgcaatccaagggactctcaagagtcttccccaacaccacagctcaaaagtcatccattctttggcgctcagctttctttatagttcaactctcatatccatacatgactactggaaaatccatagccttgactagacggacctttgttggcaaaataatgtctctgcttttgaatatgctgtctaggttggccttaggagtaagcatcttttaatttcatggctgcaatcaccatctgcagtgattttggagcccagaagaataaagtcagccactgtttccccatttatttgccatgaagtgatgggaccggatgccatgatcttagttttctgaatgctgagctttaagccacctttttcactctcctctttcatcaagaggctctttagttcttcactttctgccataagggtggtgccatctgcatatctgaagttattgatatttctctcagcaatcttgatttcagcttgtgcttcatccagcccagcgtttctcacgatgtactatgcatatagttaaataagcagggtgacaatatacagccttgacatactccttttcctatttggaaccagtctgttgttccatgtccagttctaactgttgcttcctgacctgcatataggtttctcaagaggcaggtcaggtggtctggtattcccatatgttgaagaattttccacagtttgttgtgatccacacagtcaaagactttggcgtagtcaattaagcagaagtagatgtttttctggaactctcttgcttttttgatgatccagcggatgttggcaatttgatctctggttcctctgccttttctaaaaccagcttgaacatctgggagttcacgcttcatgtattgctgaagcctggcttggagaattttgagctttactttactagcgtgtgagatgagtagtgcagtagttcgaggatttataactcaataataagaagacaatccaattaaaagtggacaaaggatttgaatagatattgcttcagagaacatgtacaaatggccaataagcacacaaaaggatgcttattattattatccatgaaggaaacgcaaatcaaaaccacagtgaggtactgccttgcacctactagaaccgtttagaataaaaaagatatctaaatacaagtgttcgtgagtatttggaggaactggaacctttctacactgcaggtgagaatgtgaaatgatgaagttgctttggaaagaagtttgacagttcctcaaaagcttcaaaacaatggtctctatgatccaataactccactccttggtatatacctaaaagaaatgaaaatttacatccaaacaaaacatatctatgaatgttcctggcaacattgttcatattagctaaaaagtgcaaacaacccaaatatccatcaactaaagaatggataaataaaagtaacatatacaatacatacagaagaatattattcagcaataaaaaagaatacggtacggatacatactgcaacatgggagaaccttgaaagcgggagccgagttaggcattactgacacattatgctaagtataagaatgggacaggaagtggtgactcactccagtgttcttgcttggaaaattccatggacagagtagactggtgggccacagagtcagacatgactgagcacacgcacatcaagtgtaagaagctagtcacaacagacaacacattgtatgattccatttatatgagatgtccagaacaggcaaagctataaaaaagaaaatagattagtgcttgccaggtgttagtgggaaagaggaatgggaagtgactgccatgggatttctttagggggaatgatgcaaatattctaaacttagtttgaagcggcaagcagagacattacttagccaacaaaggtctgtctagtcaaagctatggtttctccagtagtcatgtatggatgtgagagttggagcataaagaaggctgagcaccaaagaactgatgctttcgaactgtggtgttggagaagacacttgaaagtcccttgaactgcaaggagatcaagccaatcaatcttaaaggaaatcaaccctgaatattcattggaagggttgatgctgaagctgaagctgaagctccaatactttggccaccgaatgtgaagagctgactctctgatgagtaatcctttaccctgatgctggtaaaggattgaaggcaggaggagaagtgggcaatagaggatgagatggttggatagcatcaccaactcaatggatgtgatttgagcaaagtcctggagatagtgaaggacagggaagcctaacgtgctgcaggtcatagggtcacaaagagttggacatgactgagcagctgagcaagtttgaagtgatggttatccaactctgccaatatactaaaaccattgacttgtctactttaaatgcaggaattttatggtgtgcaaattaaacatctcaataaagatgtttttcatttgacatttagctgacatgtgatatttatttgtgagttttcattaccaaaatattttcagtgttatgttacttccttttaattcaatgatcaaaacatttacaaaataaattaatagaatacttttgggaaaaagcatgaagatgtttttttaaaagggaagtggggtcgacccagcaaccaaaatgaaatgggcccaagagcaaagagcctggacccaaccatctgggttttttctcccaggactcttgatgctaactgcctcatctcccacctgtgggcccaaaagcctttcccccttctgtgtttggtgcctaagcctccctgcctggacttgacttccctgagctagtgtcctgttcattctgtcagcccctgtctgtcctctggccagcccctctctcactgtgcctaacctggcacactgtgtctacatcgcatccgcatagtgagagttgtcacgtgctctattatgatctcaatttgacagacatggaaaatgaggtcatagagatgaccaggttcacatggggagtaaatggagaaggaggagtcgaatctaactcaagagacaaccaggtaccacttggcatcagctggcacttcttgacagagtgttggtggaggccaacatcatgatgcctagttcttatcttctggggcaaagtcccaccgcctcagaaggactgggctatttgagcccttcccctctgggatctccttggacccttttttctcattttcccactcttccccctaaagattgtgttgcttcccacagccagtgcctgtggcctcctgtggctactggaggcccactttgctcaaaactgtagtgctgaagtgtctgggaattgccattcccccaaggtggctcttgggcttccctgctggctcagatagtaaagaaactgcctgcagtgcaggagacctgggttcgatccctgggtcaggaagctccttagagaatccactccagtattcttgcctggaaaattccatggacagaggagcctggtgggctgcagtccatagggttgcaaaagagttggacatgactgaacgattgacactttggcttttatcctctcactgatgatgtgtaattaagcaaggcccagcttccctgcctccactggggacaactctgaggtgtaactgacaccctgcagccccctataagatcaggtggaagcagccactgaacagtcttgcgtgagatcatatccttgcttggtttcctctcctgccttgtcctgctttctcgcctccttacccatttcccttgggagcttatccttgatagactactggcccgtgagcctttgtttctggtctcctgggaaggctagcttggggcagacacagttgaagccctgagcacagccccgagcccatcgcatgcacgcattaggcagccctgacactggctctgctgtcctagtgaccagagcttctgaaggcagcctcctcgtctcccacttgaccctcagttttagcactaattcttttctgacttattggaaaagatcctgatgctgggaaagattgagggcaggagaagaagggggcaaaagagggtgagatggctggatggcatcatcgactcaatggacatgattttgagcaaactcctagagacagtgaaggacagggaagcctggtgtgctgcagtccatggggttgcaaagaattggacacgactgagtgactgaagaacaactttgttttttaaactttattttcagttttttttttaagtgtaattagaaactttcaatacagaaataatcccagcaaaccattcaaaagctttgttattggacaaaaatttcacatcaggcccacaaggacgctggtccagccctgagtcccccacccccaccacccattcatgcatgtaacactccatgggacaggcaggctgccatccccaaatcaccccaccacccaggtctcagccagaagccacagtggtttctagcttgggctggaaacttccagaactctctcctctgattgcttgaatttacaagcattgccacccctgtgtcatctgaatgctcaggaccaagctgcggcccacccaggagctccgcactctccacatcctccacggagcccatgatggccaggtcagtcctgaggatggggactgagtggggactcccagcacccagccaggcaaggctgcctgctgccgccccctccagcactgccttcccggaggtccccacctcaagcaccaattcttgaattggtgaaagaggtggagagagcagaaaactagagatcagggatcagtcttgggccctaaccctgtctgcttctcttcagagctaccatctagcagtgctaccatctagcagtgctcacatctggccttgaaggtgccacctgccattacaaaagatttttaagttttgcgaaaagttacattcagacctctaagaagccagcttccaatgctttccctgccccaccccctaaaaataaaaataacgtatttattgagagtttaatgtgtaagtataaaaaaccttttgtaataaaataaaaatatcaaatatttataatagtccttgtcacacactaaggtcttttcaaagtacttgaaacatattagttcatcgaatcttctcaataaacccatgaagccagtgctgtcaacatggtcagtcttattttcacaggtgaacagatgaggtcagagatgctgaggaacttgtccaaattcacccaggcagaaagagtggagccggggtttgaacttgattagtgcagcctggagtctctactctcaactgtgaagctctcccacctccttataatgtagcagagggggtggtctcatgagcaggccaagagagcagtcctagccttactcctgtgggtctgctaagtgcagaagtcggtggtctgaaaggtcgcccctcccctgtgtgtgcacacgtacacactcactcatgtaggtttcttccagggcccagagttactcctctctggttaagcgtctccatctctgagagagttgctgttcctcaaacccacacagaacaactacttcctgctgttgcccacccccagacatactcatttcgttgcattgttcagcaattctccaacaaagctctgatccagccttttctagatagacagcctctgctctactgaggacggaaaggatgatgtgggcattttcatgtctcatagcaccttgaatacccctccaagtgaggagcttggaaagtctttggaagatgcatggatgaaggagaaggaaaagagccactaagtggtttccaaactgtgttctgaggaattcgggtggtccctaagggtactgcaaggctcagccctggcggatcgagagaagggcaatgccaagttgctgggagaggtggggtgcctttcttgtaaccttctcctgcctctagggtcctcactcaccctcttcccacttcaaccagagaagctctgtctccatgttttgcatgtctttaagtaatctgctgctcaaacagtatgtgaaaccccatttccaaggagaagttagaagactcctctccctgtagcaggtgacctgacttggccacagacatcctaccttatatcctaccctctgatgacctctgatagtcatggctccctcggagggtctgtctctattacactctcctaaccagatgctgaaaactaagatcatggcatatgggcatcacttcatggcaaataggtggggaaacagtggaaacagtgacagacattatttttttgggctccaaaatcactgcagatggtgacttcagccatgaaattaaaagacacttgctccttggaagaaaagctatcatcaacctagacggcatattaaaagcagagatgttcctttgccaacaaaggtctgtctagtcaaagctatggtttttccagtggtcatgtatgggtgtgagagttggactataaagaaagttgagcaccaaagaattgatgcttttgaactgtggtgttggagaagagtcttgagagtccgttggcctgaaaggagatccagccagtccatcctaaaggaaatcagtcctaaatattcattggaagaactgatgatgaagctgaaactccaacagtttggccacctgatgtgaagaactgactcattggtaaagaccctgatgctgggagagatttaaggcaggagaagaaggggacgactgaggatgagattgttggatggcatattgactcaatggacatgagtttgagtaaactctgggacatagtgaaagacagggaagcttggtgtgctgtagtccgtgggttccagagttggacacgactgagagactgaactgagctgactgaatcagatgttgagccagatggcaattaaccatcggtgagtgtggctgcttttaagtcatccaggtaaggtagcctgtcactgtgtcattttccggcatccctcacactagcctggctcccaggcaagaatgtgaaacctgagccggcagtcttagagtgggcttggtgacacctttggtgggagatccttaggaggcattagaccagcacccttccctgggctctttgttactgggaaccaagtgtggtccccaggcagcagagcagcagcatctggggacttgttctagaagcaaaatctcggacccgcccaagtcctgtggaaatggacaggaaatttccagtcctgcttcatagccctgccagtcattcccctgctcgctggctttggaggacctctgctctgggtaactgagtcaccagcaccctttcagctcttatccactgtgagtcagtaacccagtgggtcctgtgtcttggagctgacagggattcaggcgaggccccctgtgaacacattcaggcacaaactgtggtttcaggaacttgtgtagatcgaaggaaggtgttcaaaaaccggaacccatgtgtttcccatcccagaaaaacccacagagccttcttgtatgtaggtgcttcaagagaggaaacatcacacaggtttccttttagttctatgaaaaagttagtaatcctgggaacattgaaaagccgtgtgatgtcttgggatctaaaaccagccaaacaggatgggattaagagtcactgggctttggaaaatgtcccactttccaggtatcagtaggaagtcctaattgtgtgattcttggacaagtttacttcttcctttctaaagtaaatcatttgttttcactggatgatcagttcagttcagttcagtcgctcagtcatatccaactctttgtgactccatggactgcaggacaccaggcctcccagtccatcaccaactcccagagcttgctcaaactcatgtctgagtcgatgatgccttccaaccatctcatcctctgttgtccccttctcctcctaccttcaatctttccaagcatcaaggtcttttctaaggagtcagctcttcgcatcagatggtcaaactattggagtttcagcttcagcatcaatccttccaatgaatattcaggactgatttcctttaggatggactgattggatctccttgcagtccaagggactctcaagagtcttctccagcaccacagttcaaaagcatcaagtcttcagcgctcagtttactttatggtcccactggctgatggagacactgaaatattgtgtgaagctggtcatgtacttcaggctttggaaaatggtgagtgtggaataactaattacaataaaagcttgctctgggcttccctggaggctcagtggtaaagagcccacctgccaaggcaggagacatgggtttaatccctgcccagggaagaccccacatgccatggagcaactaaacccatgcaccataactactgagcctgtgctctagagccaggagctgcaactgctgagcccacgtgctgtaactactgaagctcgtgcaccctagagcctgtgcttcacaactggagagtagccctcagtccctgcaactagagaaaagcccgtgtggcaacgaagacacagaagggcccccaaaataaataactcactaaataaataaattaatcaatttttttttaaaaaggttgctccatactgaatgtctcagaacctgaaaattcgtcaagcctatggctttctagcctctgtgatgctctcagcatcaagagtatgccacacctttgattctctgtggctagttttcaaaacacaaagcaaggcttccaagatgctctatttggctattgttttccttttgtggtgtctgcttacaaatgctgtaatttttattttttatttttttgatggatgtgcactccttcctaaagactgcagtaagatccccacctttccacctgcatgtcattcctgcaaaaacatattagtatgtgtgcatgatagaaggcaatcactttcagaaagacatccaaccctaagctttgaatcacgttatttttcacacaccaacaaagaacaaatgcatttctcaatgatgaaacccatctgtgaggtgcctttcaaagcaggcagttttgcagctagtccttggatcaaattcttcaatcatcttgaaacagtagttgcccctggcccgctgcacgcttgcttgtgcaatacgatagcattgtgtgctttgctttttaagtttaacacgttttccattcattccaactggtaccaaagtgattctgaaacactgaaggtggcaataaacagtggtaacaaccccttaggaagtattgtcaccaatcaacttgaagattccagtggccgctgagctggaattgggtttccctgcctgaaaccactagaccttcctcctgggaagcattctctggacacacagatagcactgcatggaatctgtcctaggctcgggactccatagccataatggcaggagaccaggcgagtctttgaagccatctgttatggattgaattacatacctccaaaaaattccgaagtctaacccccagcacccgggaacgtgatcttacttggaaatagggtctctgtagatgatcaagttaagatgagattcagcgtgactggtgtccttataaaaaggggaaatttgggtgctggacaaacaggcacacagagagatatcatctgaagatgaaggcagagaccaaggtgatgctcctacaagccatgggacaccaaaggcagctagcaaactacctgaagctagaggagaggctggggacaatgagtacctcacaggctcggaaggaaccagccctgccgacaccttgatcttggacttccagcctccagaactgtgagagaatacgtttctgctgtttaggctacccagtgtgtggtgctttgttacagcaactctggggaattaatacacacatccattcaagtctacagatgaacctctgagtcctgagggtcccatagaaataagcagttagggaaaaactgagccttcttagaacatgaattgcagtcaactatctttccattattgtaccatcatctcactgccaaaggaaataacctaagccttgccttgagagatcgatcattgtagcatcactccccaaggcttctttttaaattaaagtctctttctctagcaccaaagtgctgagaacatgaaggtgaccaagattcagcccctcagccaggagatttctctgcggcagagccttgtttagctttgatgtcctggtggttcaatcggtaaagaatctgcctgtaatgcaggagacccagtttcaatccctgagttgagaagatcccctggagaagggaatggcaatccactccagtattcttgcctggagaattccatggacagaggggcctggcaggctacaatccatggggttgcaaagagtcagacacaactgagaactaaattcattcattccggaaggtttgatgaaccaaattgggcagaagtatggaaggaccccatgttggtaagggaagcagctgagatgaaagggcagggcggaatctctagcttctcccccagccctgggatgcatcacctaaagacaaacaccagagcaccttggtggtccgcccggccacctcgtcctctctgagtgccctctggtgttctgaagtcatgacaacagaattcattcaacagtccaaaggtctgtctgtctgacttcatccaaaggtctgaagtcactcacagtttcttcctttagaaagctagaggagttctttgggggaactcatctgctgagaatcttccaactctccaaggacacagaggtggcagttctgaactcagatcttagtttactttcccaactgctcccagcagtttctaacctcgaatcttgctactgtatacgaagcctgtccatattccactaacttttcccacacacttacatcaagccctgccacacacacacaaatgagtgcaactctgactccagtttctgggcccattgtgagagctgggttagtctctacagccagtgtctcaatcctggtcctggactgacactgacatttggtcctggtcattcttggtgtgggcttcccaggtggcacagtggtaaagaatacgtctgccagggcaggagatgcacgaggtgtgggacgatcccctggagtaggaaatggcaccgcactccagtattcttgccgggaaaattccatagacagaggaacctggtgggctacagtccatgtggctgcaaagagtcagacgcgatgagaatgcacaacgcagctcatccttggcttgggggtgtccttgtgtggcaacattttgcagcatccctggcctctgcccatagaggccagtagcatttcctccccaaggtgtgacaaccaaagatgttctcaggtattgtcaaatgtatattaggggtaaaaatctcctggttgataacacagtgctccttacattaaaaaaaaagtatctttcactccatgaaaatgaagtcatcgatcataaagttctcttttattttggctgccatacttaatctatttttgcatttttaattaatcagattgtaacttattatgataccattgatccaattaacataacacaactttacaatttattgttacaatataagcctctatatgtgtcaaacacatgtgtatacacatatattaatattcaatatacacatattaaataatagtatatattatatttgtgtaaatatatacagtttatataaatacatgtataaatataaatatatattataaatatacatatgtgtgtgtatatacatacataatatatattttaattacatattacacatatagttaatgccacaagtttattgtttatactcaaaaattatttccagggcctttattttattccagagtaggaaatagcaacccactccagtattcttgcagaataatcccatggatcctggcaggctacagtccatgaggtcacaaaaagtaggacatgacagagcaataagtaataataatttcttgttaaattttcaaaataatcctacaggctagacattacactccttgattgttttctctatatttcgactttaaaaggactgaatgtcctgatcaaagtcagtgaggggaggagctagttagtgatggtgtccatttccacacctcaatgctgagtatgcgacccttcacccttcacgcctgagcttggctggcagccgtgcgtcctgtcttgcactgagatcctggacgaccactgaagtttgctgggactaatatctagtggctttagtgagtggcagtagcagccaacataatttgagagcttactctgcatgtggcaaggagctcaggccctgtctcacgtcagccttacaacagcctcacaagggataaatcattatcactattttgtggcttaggagatgcagactcgaaaggctgagcaacttagccaggcctagggccactgctgggccggaaaccaggcctccctcccgtgaaggtgcctccagtttctcctcccaggctctttctgtaattcttgactgccagatgcaaccaccagctccctagcctatagccacatgtccttggaagaggctgtttccacagttgttttagttcctcaaaatgtcacataattgtttttttttttccagttcagttcagtcgctcagactctttgccaccccatggactgcagcacgccaggcctccctgtccatcaccaactcccagagtttaccccaaactcatgtccatcacatcggtgatgccatctaaccatctcatcctctgtcgtccccttctcctcctgccctcagtctttcccagcatcagagtctcttccaatgagtcaactcttcgcatcaggtagccaaaggattggagtttcagcttcagcatcagtccttccaatgaacagttgggactggtctcctttaggatggactggttggatctccttgcagtccaagggactctcaagagtcttctccagcaccacagttcaaaagcatccattcttcggtgctcagctttctttatgtttattatttatttgcctgtgccaggtcttcactgtggcattcgggatcttctatctcggtttctgcaggcgaactcttaaatgctgcatgtggtatctaatcctatgaccaaggatcaaacctgagcctgctgcctagggaacacaaagtcttagccactggaccaccagggaagttcccataactcttttctatctgtataggtcttgcatgctttctcctaagcagttatattacattactagtgtcaaaatccactctgggggctgcaatatttgtttcatttccctgattgataagtaacttattgtctacactcatatcactctgaacatgcccaatctcgtctgatcagtgttttatcatagcggtaatgatagtaatcataggagcagcaatagcagaaaagctaaccatcataatcaggaaactcaagttcattttattaataatggaaaggagcaattttactgtaatggtggagtattggtctcctagagatcttgtaacagagtgccacaaactgggaaagttaaaacaacaaaaaatctattatctgagagttctggaggctagaaatctggaattaaggtattggtagggtcacagtagaggcttccctggtggctcagatggtaaagagtctgcctgcaatgcaggagacttgggttcaatccctgagtggggaagatcctctggagaggggaatgggaatccagtattcttgcctggagaatccccacgggcagagaaacctggcaggctacagtctatgggggtcacaaagagctggctatgaatgagcatgcacgcagggtcatagtccctcaaaagtctctactggaggattcttccttgccttttccagtagactcagacactccctggcccatggctgcatcactccaagctctgtctccgtcttcacatggtctcccttcccccgtgtctgtctttgtgccatcacctggttgtcttctttttttcactgttgctttattcttttttttttctttttgattgtcttcttataaggacaccagttagattaagattccaccctactctagtatgacctcagctcaactaattccatctgcaatgactctagttccaaataaggtcactttctgagatactgagagttaggaattcaacaagtttttttgagtgtgacataaaattcagtgcgagcaggaagtactagggctcatctctaaatctaacagattatgcctgcaaccttgcagtatttggcatgtttggggataattaaagaccgggagctgactgtggctcaaatcatgaactccttattgccaaattcagacttaaattgaagaaagtgggaaaaaccactagaccattcaggtatgacctaaatcaaatcccttataatacagtggaagtgagaaatagatttaaggaactagatctgaaagacagggtgcctgatgaactatagatggaggttcatgacattgtacaggagacagggatcaagaccatccccaagaaaaaaaatgcaaaaaaggaaaatggctgtcgaggaggccttacaaatagctgtgaaaagaagagaagccaaaagcaaaggagaaaaggagagatattcccatttgaatgcagagttccaaagaatagcaaggagagataagaaagccttcctcagcaatcaatgcaaagaaatagaggaaaacaatagaatgggaaagactagagatctcttcaagaaaattagagataccaaaggaccatttcatgcaaagatgggctcgataaaggacagaaatggtatgaacctaacagaagcagaagatattaaaaagaggtggcaagaatacacagaagaactgtacaaaaaagatcttcatgatccagataattatgatggtatgatcactcacctagagccagacatcctggaatgtgaagtcaagtgggccttagaaagcatcactgtggacaaagctagtggaggtgatggaattccagctgagctatttcaaatcttaaaagatgatgctgtgaaagtgctgcactcaatatgtcagcaaatttggaaaactcagcagtggccacaggactggaaaaggtcagttttcattccaatcccaaagaaaggcaatgccaaagaatgttcaaactatcacacaattgcactcatctcacacgctagtaaagtaatgctcagaattctccaagccaggcttcagcaatacgtgaaccgtgaactcccagatgttcaagctggttttagaaaaggcagaggaaccagagatcaaattgccaacatccgctggatcatcaaaaaagcaagacagttccagaaaaacatctatttctgctttattgactatgccaaagcctttgactgtgtggatcacaacaaactgtggaaaattcttcaacatatgggaataccagaccacctgaccggcctcttgagaaacctatatgcaggtcaggaagcaacagttagaactggacatggaacaacagactggttccaaataggaaaaggagtatgtcaaggctgtatattgtcaccctgcttatttaacttatatgcatagtacatcatgagaaatgttgggctggaggaagcacaagctggaatcaagattgccaggagaaatatcaataacctcagatatgcagatgataccacccttaaggcagaaagtgaaagaggagagtgaaaaagttggcttaaagctcaacattcagaaaacaaagatcatggcatccggtcccatcacttcatggcaaatagatggggaaacagtggaaacagactttatttttttggactccaaaatcactgcagatggtgattgcagccatgaaattaaaagacgattactccttggaagtaaagttatgaccaaccagctgctgctgctgctgctgctgctaagtcatttcagttgtgtctgactctgtgcgaccccatagacggcagcccaccaggctcccctgtccctgggattctccaggcaagaacactggagtgggttgccatttccttctccaatgaatgaaagtgaaaggtgaaagtgaagtcactcagtcgtgtccgactcttagcgaccccatggactgcagcctaccaggctcctctgtctatgggattctccaggcaagagtactggagtagggtgccattgccttctccgatgaccaacctagacagcatattaaaaagcagagacattactttgccaacaaaggtccgtctagtcaaggctatggtttttccagtagtcacatatggttttgagaattggactataaagaaagctgagtgccgaagaatcgatgcttttgaactgtggtgttggagaagactcttgagagtcccttagactgcaaggatatccaaacactccatcctaaagggtatcactcctgggtgttcattagcaggactgatggtgaagctgaaactccaatactttggccatccaatgcaaagagctgactcatttgaaaagatcctgatgctgggaaagattgagggcaggaggagaaggggacaacagaggatgagatgattgtatggcatcaccgactcaatggacatgagtttgggtaaactccaggagttggtgatggacagggaggcctggcatgctgcagtccatggggtcacaaagagtcagacatgactgagtgactgaactgaactgaactggggatgaggatacatgtgagacattggcctgtttccataaacattcaagaaggaaagaagtagaaattaacagaaaatgtcccttgcttcccatccctctgcgaaacatagaggcaggttttttggtgagcaaatgggcgtaaattttgcaggaatggcacacaccagggcatttgacccagttagggccagggccaggtacgtggttacggatttcttttctggtagctggatataggatggacaaactgtgccttctctgcactgtctggctgttcctgtcagagacccactgctctcctggattctccccagatgcaaacagtcacaaatgctgattgccaacgggaggaagtaaggctcttcaccgctgggccagaagcattcaccacccagcacagcctttggcagccacaccatcatcacttgactgtctgtactggctgatggcaaattctcccatctcccatctcagtggtgtggtcgctgccagggcctctcaccgcttagtgttcacactcttgtgttggcctcccagatgaatcaggttgacgtgtgtgcgtgtatgctcagtcgctcagtctgtccaactctttgcgaccccatggattgtagcccaccaggcttccctgtccataggattttccaggcaggagtactggaccaggtgccatttccttctccaggggatcttcctgatccagggatcgaacctgtgtctcctgcattggtaagtgggttctttaccactgagccattggggaagccccagtgtatatccagaatagttcagtgtgatatctgaggccaggtcataaaagttcttgaggtttctcccttcaccatctctggccggagccagcggccacactccgaggacactcaggtagcttgtgggcagcccaaaagggaggaactgagacgttccaccaaaccccagcatcatttgccaggcatgtgaggggcccccttggaagcaggtcctcgagccccagtctagtcttcagacgactctgcagccccagctgacatcttgctgcaatcaggtgagaaactctgagcccgacccatcctgctaagctgctccggaattcctggcccactggcactgcgaggtgagaagcgtttgtcgttgtgtgaagcagttaagttttagggtgttttgttacaaaggcgtgggccactaatacagttacttacaatgccataagacaggtaggacagcgtttactgttgagaaaatacccctcagggttaaaattagaacccaaagggtcttttccaatctaaaggacttcagtggagcagaacccctttaccatgaggctgtgaggtttagtcagtcagggcctgagcaacagataattttctaaatcctaagtaactagccaactgcaagctctgagtggaagaagatgtgcccaggcccatctgcggagcttggcctaccacctggtaattttgttaatgattcagaggcacgttgggagggtcatgaccagggtatgcagcacttccactgaggttctccaagggaggacagcagttttcgaagaagatgtatatgctgcctggaaggtgggcagcacagatcctgctaaaagctagggttgactccagcagggatgtgaacccgtgcaggtagaggtgggcggccagaggcagggggagaaggggctggcaggcaatggaatgtcatctgcaatgtcaccctcaagcacacaagccagctgggggttcccgctcaccgggaaaccattctcaggcctgtggtggctctgcccctgtgatgagatgaacctgactctggcaggaggctctgaaggccagcagaggccctcttgagttcctgatgtcccttcacagactccagaccataccagtcatggaggagggacagggctgtcaagtgacttcacataaatgatgtttcacatatgaaaatcgttctccatcaggagatgtgccctgtgagcactttctctactgaactgattctcaaactacactatgcattagaatcatctgtccgactgaatgacttaaaccacagaaattcattgccccacagtcctgaaagctagaagtccaagatgaaggtgtctgcagggctggcttcttccgaggcctctcgccttggcttatagccgcctgcctgttcctcgtgtcctgtcgtcttacttctgcgtacgtccttgtcctaattcccttccctacaaggacaccagccacagtggattagggacccaccctaatgacctcatcttagcttaattacatctttaaaggccctatgtccaaatacagtcacattctgaggtcctggagggttaggatttcaacccaggaatttgggggacacaattcagctgttaacagaggtaatgtggtcttcatgagggttaatcagataggacacttggtgcttggggtattggatgcaatcaggagttgcaaactattgctttccattccctccaattctggtggcactagatggaaaaattgcccctgaacagtgggtgacacacaggaagactggacttttctttcagccactaatccccttaaaacatctggtctgcccccacccccaccccaagggccagtgcaaatccacccgcgggagctgtgagcagctgcggaggccatgggcctggtttcccagaatccgagcttaacacttaagactgagtttcttttcaaaagagctgagggctcaagcactttgtcgcacctaatcctttttcagaaggaggcaggtgctttcatgcagccagagtcctctctgtgggcctgcaaaggggtccagagttttccccgccgggtctcacccacttccccggggtcccaggtggcttggcagtaaagaatccacctgccaatgcaggagacacaggttcaacccctgggtctggaagattcccctgaagagagaaatgggaacccactccagtgtttttgtcagaaatcccatggacagaggagcctggcaggctacagtccatgctgtcgcaagagtcggtcacgacttagtgattaaaccaccgccaccaatattccattgtatatgtgcaccacatctttttacccattcatctgtcagtgggcatttagaggggacattcttttttaaaaattgaagcatagttgatttacagtgtttcaagtgcacagcaaagtgattctgtcatgcatatatatgtgtgtctattatttttcaggctgttgacctattttccatacagttgtatgtatctgttaatcccaagttcctaattgaaccccaaacatcccactttgtgggcttccctggtgactcaaacagtaaagaatccacctgcagtgcaggagacatgggttccatccctgggttgggaagatccctggaggagggcatggcaacccgctccaatattcttgcctggagaatcccatggacagaggagcctggagggctacattcatggcatcgcagagtcggacacgactgagtgactttcagtttccactttgataaccagaaggttgttttccacatccgtcagtctacttctgttttgtaaataagttcatttgtatcatttttttagattccatatatgagtgatatcagacagagaaggatacacagcatatgacattcacttttgaaaggagaaacagagacaagatgcaagagcttgtctcaggaaaccaagcctgaagtcccaagtttctgcccggagtatagctatccatgagctgtctcagattgctccaggggaccagcccaggagaggtgctgggactcatctggtgttagattcaatacgtttcacgtgaagttcaagtaacttgaaggctctctctagggacttcctcagcagtcggtggttaaggctccaccttccagcgcaggaggtgggagttcagttcctggttggagagctaggatcccacagacctcacagccagaaaaccaagacataaaacagaagcagtgctgtaacaaattcaataaggactttaaaaaatcggtcacattaaaaaatcttttactgaggcttgagacgagcaagagggggaggcccaatgccccttcatcaggatgtagccagagagaccttgacatccctattcccaaagaactgggcctcccatctcctgaggggggaatgttaggtagttagaataggaaacaggagtccagaatggtggtggctaaaaggcaaagaaagggaaaagtctgaaaaaatggaacaaaagaaaatccacggaccagagtgaggacctcaggtgaaacaaacaaattggctagcccaatttgcatagagcagacttcaaatggggcggggtcagggagagggcggtggaggagacgaaacatataaaaagaggaagccaagacagattgaggcgtctcctttggggtctgcctgacctcacgcctcgagggtatactatcctttgtttgccaaataaaactctgagctgtaaccaagctgtaaaaagaaaaaaaaaaaaaaatttaaaaaataataaactggtgagctttttagaaaaatcaaaatgtgaagactactctttcagatcactggcttctgtcttatcttatcccttttgtcttgccttatcccagacttccagcatcttaatctgcataaaatcattaccatcattataaagtgatccaaactatcctttgcctagattcttccattaacaggaggctcacaaaggtataccaagattaaaatgatggcccggggaaccacagaagtattcttctcataaatgttctgtggcttagtgggtaaagaatccacctgcaatgcaggagacccaggttcaatccctgggtcaagaagatccctggagaagggagtggcaacccactccagtattcctgcctggaaaattccgtggacagaggggcctggtgggttacagtccatggggtcacaaacagacacgactgagcacgcacacatgcagagctcaaatatccccctgagaactaggtatggttatcattctacctatttcataaatgaggaaaccaaggcacagagagactaagggacttgcctcaggtcacacagctggaaccctgcagcacagggagttaaatgcaggagcgcctcaccagggctgctcctcgcagcagggaggtgggtgtgatgccctcccaggaccagagtgctcattcacactcaggctctccagaaaacctgctgtgtccacaaggctcactgtcaccacagctccccaaaggaaggactagctttgtcactggtcattgtattccagcacccagaatagaggcaggcttatagaatcattcagtatcggtcaaattactgagtaaataaataataaaaggaatatgggttctttgcagagaatttggaatacatgggaaaaaaaagcattttaaaaaatcacaactataatcccagcacctacagaaaactgctaatgtgttctggccccaaatattttgagtagatacgtttaacgattcatttcttctctgccaattcctactcctaggcaatcattttcaatttacagtttcttttgatgtttacatcttatgtaacatgtgttgaagtgttaagtcgttcactcatgtccaactctttacaaccccgtgaactgtagcccaccaggctcctctgttcatgaaattctccaggcaagaatactggagtgggtagccattcccttctccaaggatcttcccaacccaggaatcgaacccaggtatcctgcattgcaggcagattcttcaccatctaagccaccagggtattgctatttcttggtttttcagttttagggggctgatgtcctttactcttttacataaagcacatgtatacacatacactcacatacacacacacaggtgccttttctccattctccctctatagtttcattgaaattttggagactaatattaagcttttacattattataattctgtaaatgctgtcaatagtggaactgtattatgtttttgtgttcctcaacaacttatgcttatgcctgaagttaaccattgccttatatttttggtctgttttagtaatttatccctcaacttttccctcctttcaatgtgctcacacactaagtccatctttttgaagaaatttcttcaagaaccttctggattggttaccctttctgtctactaagcaactctgtctactatgtattagaggtaactttacctctcttttgtgaaggagtccctgtttcccagaccccacatcttctttttaaaatttaaaaaattttacttctttttaaataaaaatatctccagtagctccttcaatttgttgttgttcagtcactaagttgtgtccaactcttcgtgaccccatggactgtagcccaccaggcttccctgtccatgagatttcccaggcaagaatgctggagtagattgccatttccttctctggggaatcttcctgaccaggaatttaacctccttctccagcattggcaggcagactctttaccactgagccaccagggaagcccagcttcttcagtaaggttttgcatatctgaaaagatatttattacaccctcacatttaattaatagttttgctgggtatagaattttgcctttggaaatattttttcttcaggattctgaagcatttatccactgtcttctatcatcttattgttgcaaagtccaatgccattctgattcttggccctttgcagaaagtgtgttttctttttcctccctggaaacactcagcattttctatttcagtgtgatgaaactgcacaatgatgtgtcttggtgaatcagtgttcatctgtggtgctgaatataattgggaaattcagggtcttgatatctgagttttcatgaattatttctttgggaaattttctctctttgtctctgcatctgctttccaaatttgggttagacattctggtgtgctcctacaatttcatctcttctctgctatattttctttttattttcactacacattctgagtactgtccttgacattttcatttcagctctttccaagcactttcatttgttctgtgaatgatttttcttagaatcatattttctttttctctagttttattgagatagaattggtattgttgttgttgtgatttggtactaagtcatgtctgactctttgagaccccgtgggctgtagccctccaggctcctctgtccatggtattctccaggctaaaatatggagcggggacttggggaatgtcatgtacacactgctgtatttagagtggatcatcaacagaaacctactgtataggacatggacctctacccagtgttatgtgccaggcaggatgggagtggggcttggcagagaatggatacgtgtataggtatgactgagtcccttcactgttcacatgaaactgttacaacattgttaactgactatactctgatacaaaatgtttggatgttttttaaaaaatctaaaaaaaagaaagaatactggattggtagccattccattctccaggggaatcttcctgacccagagatcaaacccgggtctcccacaaagagtaggtcatggctcactttcaacacagtagagaagagaggaaaaaagacctgaagttggacttaggtagttctctccattttctggaaaacaagcagtttaaaggtccaagagaccttgatctgtgtgctcttgaggagcacgcactgccccctggtggacaagctggtactgcttttagagctctccacgctttccaagatgacgatgtgaagtcctgatagtactgccagaggaggtaagacttgaacccagatcaggagagaagaggggggaaagatgtttgaatttagacttctgcatttcttcccaatcaatatgtccatgccagcatcagtaagcacagcccctgtgtatggccctgtaactatcactggggatttagcattactgtgggaaaactattttcccaacttctcagctgtcactaccctgcacaaaggggaaataccagttttaagaaggaagatgtacatccacatgaaactcacctgcataatttcaccccatgaccttctgccactgtgctgtccacatcagccgtgtgtggggctctcctggtggctcggtggtaaagaatctgcctgccacgcaggaggtgcaggtctgcccccgggttaagaagatcccctggaggaagaaatggcaacccactccagtattcttgtccggagaattccatggacagaggagcctggcaggctacagtcacaagagagttggacacgacttaatgactacacaacaagaagccatgtatgactgtttaaatgtcaatttattaaaattaaaaattcagtttctcaattaactctagccacatgtggctaccacatcagacagctcagacagagagcattcccactgcagcagaaagttctgtgtgatggcacttgcctgagctcctattggtacccagatgattctcccagacagaagttgccacaatctcacccatgttgctataagtcatggtcccaccacagcaacatccatcacagtctgacttaaatggagtcagttaggtgatagccctgtctctcccacctgaccataagcacataggggctgggaccaagcttgggtcatctgctattactcctggtacttagagaagagataggcaaagagcagttctggaataaatattagttgaatgaatgtcttgattgtaaactctctgagggcaggcatgaaaaattctcatttatgtatcccccacagttccctgagcgaagagggaacctcagcaaatgtctgatggattgctctcagacctcccagcctaaggaccaacctcagcactgagacaaaaagctggacggttgtgttccccagcatcactcaccaagccccacatctctgtcttcatacacattgtctcctgaggctttgacacatccccctccctacttgtttgctgcttccccatgaggtctgatcaccatcactcccacacaattcacacacacacacacacacacacatgcacgcgcgcacatgcagcctccaaattctttctttgacatcctttcccctcccttctcatacctggaagagtggtctccattaccggggtgtatgcatccccaggagttgcccaatatgatcttctgaaatgtagagaaaaaatgtttagactactggggtttgtttaaatctcatcattcaaaattatcttgttctgctatatgttttaatatgttaataatatactaatacagtaatagatgcttatttgtaaattaaatacacatacttggggtgttgggcttcctgggtggctcagtgggtaaagaatccactcaaaatgcttgagacacaggagactcaggttctatcgctgggttggaaagatcccctggaggagggcatggcaacccactgcagtgttcttgcctgggaaatcccatggatagaggagcctggcgggctacagaccatagggtcacaaagagtcggacacgacggaagcaactgagcatgcacacccacatttggggtgtactctagcttatttttattgatagcagtgtatgtgtgtgaaaaaaaggcatcaccctggaataactcccacccttccacttcctggtcctgctcttgtctgagaagccagcagaaccctgcatcatctcagtataatcaggcccaactgatgtggggggaattgacagagagccttacaaaccactggtgtcttccattttttaattcttagtgtacctctagggaatacccggtactttgttcttgaattcagattatcttcaggtactatactagctttgtctttccaaccaaatggccgattccatgagcatcttgcagttatcttatactaaggacctgccagtctaatttcatttatgaataagagagctaaatagagtcagggaggtaaagcgacctactgagagacacacaagtccaagcctggctggcccactgtagaatgggactgtagatgcgggcagaggaagctcacaaacggggaaaagactttgcttccgagatctctgctcccgttcacaaaagcaaacctggcagctttggttaggagtttcctgcctgccgtcagctcaccatccctgccctggagaggagcagtacctccgtgaggcctgaagaaggtcttcacacagaggaggtgtcggctgctaacttgacaaagataagagccaaggtcatgaccttctaatggtaaaccagcctattagtttagcaatatgtgtttccactgtcagagccatgcctggtggcgatttgatttttcattattcaggaagccccttacttgaaaatgagagaaacctctagcaacctctggaaatctcttcttttcaaatgataacaagtagaatcttcacctaagaaacttggctccatgctcttttacattccgctctacccttatgctggccgagtagaacagacaaatgattcgaatgtgtgggtttaggggaaaaaaaaatatcaatcaaatgtaaatgatgatcccattaaaaaatgattttgattcaaactcaacaacacaaatttctcagactttgctattagctctgtgtcaaactttggctgtctttttgattttttttttttagtggttcatttgggatattctgcaataattttcagtttggggcaggggggttgatttttttttttttttaagtactgaccaaaaaaatcttgctccattcagtctcctgagaatgttgggttgagttttttgatccctgtgctcattgatttgcgggctgatgtagtgtgaggggtccttattagtggcgtctgtccctgctgtaatgtttttgttatttttcctcatttgttcactctgacatcatgtcattacagaatggtgctgctcaggccctggctggctgttcgttagcgtgtgtttaatgagcagcttaattgagctgtctagtaggccacctgtcgccctccggacttattaacatactaatggcctgacattgtattctctgacaggcaacagggcttactgatttgatgtctggacatgaggattttatgcaggaatgagagcgggcattgggaaggaaggtttaaaaaaccgagaattaactctttggtatctctgtgtttacggttctctcgtggaaaaaaaaaaagttcaacccatcacagtccaggaaagcaaattctgagaaggacggcttgctctatactggcaatcccagttgtggttctacaggaggaaatatatcccgcctgagaagagcgggctttgttctgattacagtgctatcgttaggaatgacttcaaaggcgaaatctgcagcctgggcggaggggtggtggagggggggaggttttgcaactagacttttctcaactgtggctaaacagatgagaagcagccatgctgcacttgagggctgtgagtgtggtctgctgtccctgaggtctgcagtcctcaactgcaatcagctggaatccagctgaggacagcctggggacactgggctccctgggagggctcaaatgcatgttggaggggcaccctggtttggtttgtgttttttgtccgagggtgtgtagctgggtctctccccctggcctcccttgcagacaggcatcaggaagaacttccaggaagtttcaggagcctgagtccggagcgtgggcatggcagtcctgcaggaagcctggacggcgctctttggtgccttctccctagctggctccccctttgatgcctgaacacacaacaagcacatacaggatcataaggaaacagccactttaaggctccaggaaagggctgaggctgagggctgtgcccaggagccaacccccaccccaccaccaaagtcatctcagaggtgggtgggagtccttggagaagagggccatctgggggctggggtgagttgcagcatcttgactggcctgagggtctccctaggtcagctgagttgctgcagagagagccaagaatcattccagatacggctgcctggaagctgcattccagaacttggtacatagaacctgcagccccaggctctctttataggaggtgctgagcaggggatgtgctgcctgccagcagtcacacttcctctcctagcgaataggagaaggctggagaaggagaggaatcagggcagaaacccaccactgtctacctgcccacttcatgtgatgatgagaatgctaataatgactacctttatttttacttcttaggtcacttttataaagataatctcatttaagttttttctttaagtgtttttcaatttcagcacagttgacaactggggccagagcattctttgttgtgtgtgaggggggctgtagaatgttgagtagcacccctaggctccacccatcaggtaccagtagcaaccccaactcaactgcaatactcaaaaagcatctccagacattgccaaatgtctcctgaggggaaagtggtatccagttcagaaacctctgctctggagatagccatgtcaccctctggttatagatgagaagcaaacactgagcatgtaaagggggaactcaaactcttgaagctaggacacaggaggcagagcaggatttagttgtaagtccatcagatcccatgccctggctcatctgttgtgcaatcttcactggttgtgatgaagagggatctggtcgtgaccagaggcggggccgccgtctacatccccagtgctgaccgtggcagagctcttgtagactgagtattttgctaaggattttacatcttctttcaaaatcttctcaatatccctttgagatagacactactattgctctcttttcagagataaggcaactgaggctcagaggaattgagtaacatgtccaaggttgcacagctagtgggaggagagagtctcacccaggtgtctctgatttcaaggtccatgttttccacaacagcaccaagacatccagacatctgcagagatccttgtcattcacctctctttccaaaaaaaaaaggacaattgctccctgtatttccctggctgaccaggattctgtgcttggtcagtttacccaagagcatgtatgatggttcattttataggttggtgtgaccaggcaacagaattcctagatatttagtcacacattattccaggtctgtctatgcgagtgtttctggatgaggttaacatttgagttggtggacttaaagcagattgccctccctagtgtgggtgggcctcgttaaaccagttgaagttatgaatagaccaaaaagctgagtctctccaagtaggaaagaattcttcctgcctaatggtcttggaactgagatattggctttttcctgtctttggactcaaacggaaacattagctcttcctggacctcaagcccgccagcgttcagattgtaaatatactgctgggtctcctgtgtctccaacttgccaacccactttgcagctcttcagacttaccagcctccataatcatgtgggctagctccttataatacatccttttgcccatttacaccctactggttctgtctctggagaatcttaatatggcaatttgtttagcttttacccatggtaacttcttatttctcatattttcaacatttctgcctcattttgttttagggctgtaaccaatatctagctattttttaaaaatgcagtctaagaatactgaagtcaaatacttgctcatgttgttgatcattggataacttaccactcatcattctacaagagcttctccataacggtcttctagtctatcaactctccctttagccttccaatttaaactttaatcaattctatcaggctttgtacattttagtgataagctgccttgttttcaggatttctaaatgtttcttttcatacccatctgttcttttctcatctctgcctggtttatctccttagttgttttttttttgtttgtttgtttaatctcggttacttctgcctttaactcttagaagaattcaacattgtgatttaaaaaatcattttcagattacactgttattttcattttctctaaagtgatctcgtctcctgattgctgtttttgttgatttggtgtaacttcaagagttagttaatttttttttattctgttgcagctgccacggctttgtacccaccactccctttctggggttggggaggggggttgttttctctatatgcattcttagagtctccagttcaaaactgcatgttatagtgggttttgagaaaatttatcctaaggagataactgggaatagtgcaggtccagtcactgagtcatttggtaagttggccagatctttcttggctgtaagcctgttgtttgcttttcctcatcttaatagatatgtatctggagtctaggcagtggttgatagaagcattttttatcctctataaggagggagctgcttcccgtccttggctctgttccctgccttgcatcagccatgtctagtttcaaccactgtgtgggaaacaagctccctgcctcctgtttccaggcccacagtccagcaggctggtagcttcggtcccactttcacgtcgggggttctggctgatggaaacgttgtctttttgtgagcgtggcagctttttaaatctatcattactctgtgttggtgccagtggaagactcaaagcctgaatcttgatggagtttgatgccccctgtggtacacacatctcaccaccattctgcagtagtttatcaaaaatctccctacagggaatagtttctggttgttagcttgggtttaaaaagcactgtattcgtagtcaacactatgggctgagtcaaactgcctgggttcaaaccccaggtcttctacttactagttttggaaacttgggccaggttgtttaaaggctttaagcctcttctgtgaaacacagcagtagtctaatttcctaaggatatcatgaggattatataagaaaatttgtataaaaatacttcccatagattctggaacctagtcagtcctcagtaaatgtctgctgttattatggtggttattactccttggtctgcatcaaatatcacttaaaaatcgcctagccaatctcctcactcaggtaagctgcatgcatgtgatagcttatggtgaacaatgtcgggttgctttatcactcaagagctttggtgtagcagagttttagtaaagtataaagagggacagagagagcttctgacacagacatagacaggggacagagagtgacccctcactagtcttatcaaggccttatatacttttaccagacccactcccacaacatacatcttaaattaacaagattacaacaatagaaaggtctaatcagacccactcccacaagatacttcttaaaataacaagattaatcagaaggttcttgttaagaaggggaaacatgtcctttggcaagatacattgtttctatataatccttgctgctgctactgctaagtcgcgttagtcatgtcccactctgtgcaaccccatagatggcagcccaccaggccccgccgtccctgggattctccaggcaagaacactggagtgggttgccattgcctcctccaatgcatgaaagtgaaaagtgaaagtgaagtcgttcagtcgtgtccgactcttagcgaccccatggactgcagcctaccaggctcctccgtccatgggattttccaggcaagagtactggagtgggttgccatccttagtacagagtttaagatgagttgttttgttatgtaatcattagctctgggcttaaagaaaataaagtgactaagacaaagcaatgtagaaaaaaagtttgtccttttcttctccttgagagctctggacccctatctccttctttagggccctggactccttatcaacctgcctaagaattaattctcacatgcatgttcagtctcatgtatgttgcaaccccatagactgtagccctttaggcttctctgtccatgggatttctcaggcaagaatactggagtgggttgccatttccacctccaggggttcttccccacccaggaattgaacttgcatctcctgtggttcctgcattggcaggtggattctttaccactgagccacctggcaagcctccaagtacgctgattctttgccaaaaaattttttaaaaggagttctttttctctggcagaaccctgactgatacagtttcaggggtggaggaaatgactcggtcaaggagatgagtcatgactcatgagttatgagttttgaggggaactgcatgctgcctaaccaacaggcagaggaaggatcactgaattgaccaaggtgattgatcccaaagccaagggacaagtaacctactaggggaatggagttctatgtggggacccaggggattcactgggatacttctgagcacttccccgtccaataggctggaacaatggaaaaacgatcatcaaggtatccatccttccagtgggaaggctcaggtgaccctctagtaaagagctcagcctcactgagggtggcataaaataagcaaggacacaggaggatacacagaaggaagcagttaattttttcagtttcaggtaggagtttgactgaatccatgtcaccccaccatgagacggtcactgctgggactttgtgtgcacttcccctcctctacccctgtgttggaggtgcgcatttctctttttttccttcaggcaagattttatcggggcccctgctgcagtagaggggaacgagaacaaacaacagggctccgttgctgcctcactcactgagggcggggcgggcttgtgcgtatagagagccggtgggaggaaagcaccttcttcaaccggatgaaagacaagagggaaaaccggggattgggggggcccgtcccggatatcttccgctggcacccccaggtctgctccccatccctctccgtggctctgggccgaggaggctgagctgggagggtggtgcggaaacacgaatggatttccggtggtcccgagacgagacagagggcgctcaggccgtgaggccaggtcctgcgccctccggatccccttctagggcgcgctgcaagctgaccgagcgccacagaggaggcctggccagggccctcagcacccagccctctctgcctcaagctcccagctctcaggcacgcaagtgataccagcatccacagtggcttattagcccagaaatgccgcaccatttcttgtggttgcccttctcccagcccacatctttataagagaaagagaagaggctggtggtggtggtggcggtggtggcggtttagttgctaagtctcttccgactcttgcgaccccacagactgtagcccgccaggctcctctgtccatgggatgctctaggcaagaatactgcagtgggttgccatttccttctccagggaatcttcccaacccaggaatcgaacccagatcttctgcaatgcaggcagattctttaccagctgagctacaagggaagccctttgtagggctcctatctgaaactgaaagcccttacatctttgtaagttgcccctttattaaactttcctcagataccataatgtgtgtgtgacacagtttcttgcttgcaccctgaataatgtagggtgatttgggcttctttaaacgctttgaggatttcttcggagattatcaaagactcgttgaaccaggaagtactatagatgctgttgggacaacattcctttcacagatgagacaatcgtggtttctctgagaccaatcatggtgaagtagtgataaatccaaggtcccctggccaagcagaggtcggccagtggcctctccaagagctactagtccgtctccatctgcctctatctcttgaatgacccctggggttgtactgggtgttaggctgtaatcacaaaaagtgaaatccaataacaagatgagagattgggggaagatgtttgcattcccaagcttcccaggataaagaatctgcctgcagtgtaggagacacaggagatgtgtgttcaatccctaagcagagaagatctcctggaagagggcatggcagcccactccagtattctcacctggagaatcccatggacagaggagcctggtgggctacagtccatggggtcgcaaagagtgaacgactgaagtgactgagcaggcacgcacatttgcattgccaggatcttctcacccagggaatcatactatatgagctttaatcagcagtcctctggctgaagtgactttggggtccagccacagtgtggtatctagagtgtaggtcaggtctagtgcagagtataaggggcagaacttgtccatcgtctgtcctgtcctcggtccttctcttggccccctctttcctctgcccccaccagctgaagctcgagcaccgtattctcaggaacccctgtcagatgccccctggtaactgaagagttaaagggtttttccagcacagtttcatggcagtttacaacaagtagagaatgctcttacatgtgggtttctagaaggcgttttgtggtgagcgttaggagacagtttgtgtgcgtgccggttgcttcagtcgtgtccgactgtttgtgagcccgtggactgtagcccaccaggctcctctgtccatgggattctccaggcaagacttctggagtggattgccatgccctcctccaagggatcttcctgacccagggatcagacccacatctcttatgtctcctgcattggcaggcaggctcttcaccaggagggccacctgggaagccctaggagagacagtgacctccccctaaaataacttccttctcctgggccagcagtgggaaagtgctcacaagacaagttgacactttatttctggcttctctgcattccctcaactgaatattcaggggtaataatctttctctgtccttgaataaacgttcctgccagccccaggagttggacagttaccttaaggggcaaacgccatctcatctcagatgttagaatgtccgcatcacgtactgatcacagctccagctgtgatgttcacctttgtctcacccccagctcagccccgcttcaggctgggggccgcggctgccggatggacttggctggtttcttttttgtttctccacctcgtgcttttgttcttctccacgtccacctcctccttggtattcggtttccatcttgtcctggataggagcagcgtgggagagaggaggccatacatataggctgcttgcatgcttcatcctgttctttttttttttttgtattgtttgcttttaaataattccaaaattacagaaaagttgaaagaatagtacacaaattcctagactgacatattcttaacgttttctcagatttcctttatcattctttcttcccacccttcattcacccatcacctgtttcccttctccaccttttttcctaaatggagataattgcaggtgtcaaccccttcaatgtgtgttcctaagatcatggagattatctgacgtaaatacataaatatcaaattcagaaaattgaacattgacataatattgggttggccaaaaagttcttttgtttgctaatcaccctaaaaatgttcttgtgtgctaagttgcttcagttgtgtccgactctttgcaaccctatggactgtagtccgccaggctcctctgtccatagggattctcccgcaagaacactagagtgggttgccatgccctcctgcaggggatcttcctgacccaaggatcgaacgcacatctcttacatctcctgcattggcagatgggttctttaccactagcgccacctgggaatcccaaaaatgttcctagtggcaaatttcccccaatccagactccaatcctgattgtgtattgtgtctgttaatctgaaaaagtttctcggtcttcctgtagttttcatgacattgatattcctgaagagtgcagatcagctgctttgtagaatattccatgatttgggtttgagctgagtagggtcgagttctgcatctctggcaggagcactgcataagtgctgtgtgtcttttacaatgtatcatgtcgggggacacatgataccagtttctcccatgtgatgtcaacgtagatcacctgggtagagtggcatctgccatgtttctccactgtaattactctgattcccattgtcattaataaacagtctgtagggagatactttcagactatgtaatactctgtttcttttcaaacttccatccccagattttgccacccatcgttaattcctgtcttaagccccaagtctgtcatcaagtcagtctgggggaactcatgttcccaaatgaagagttgttatgaattagagttgccactcacccctgtggaaggggatctctgctccctcttaacacttgattcaggtgtggatacaagactcaccccctaatcctcccttgcaagactatgttggtatgtttaaaccaatctttacttgtgggcatcacagaagaaatgtgagatgagtgtctgatgaattcatcagaagacactctctcacatcacctggatggactgcctcacgtggaccaccctatctcgacccctcaatattacattctcaagaaggagagaaaagaacaaatgttgtatgattgtctgattttgcttatatatgtataagaggcaagttcctagggacagaaagaagattaaaatttaccaggctggaaggagggggaatataaagttattgtttatgattacaagagcctctgtttagaatgaccacaaaaatttgggaatagatagtggtgatggttgcacatcatgaaggcaattaatgtcactgaattgtacttaaataatgtcacttaaaaatggttaaaatggcaaattttgtgatatatgtaaattttaaaaattaatcatgtaatgtgccaaaaacattgattgtatcatacactttaagtgtgtgaattgtgcagtatgcaaattatatatccataaagctgcttttttttaaaaaaaaaatcctcagtcacagcccctcagttacattctcaaacacacagccattgttactggttatcaacggccatgtggttccctgcggtggttgttgttcagtcactaagttgattctgactctttgcaaccccatggactgcagcacaccaggcttccctgtccttcaccaactcctggagcttactcaaattcatgtccattgagttggtgatgccatccaaccatttcatcctctgtcatcctcttctcctcctgccttcaatctttcccagcatcagggtcctttccaataagttgactcttcacttcaggtggccaaagtaatggagcttcaccttcagcatcagtccttctaatgcatgttcagggttgatttcctgtaggattgactggtttgatctccttgcagtccaagggactcttgagagtcttctccaacaccacagcccaaaaatatcagttcttcagtgctcaactttctttatggtccaactctcacatccatacaagactactagaaaaaccacagctttgactagatggacctttgttggcaaagtgatatttaatctgctttttaatactctatctaggtttgtcctggagaaggcaatggcaccccactccagtactcttgcctggcaaatcccatggatggaggagcctggtaggctgcagtccatggggtcactgagggtcggacacaactgagtgacttcactttcacttttcactttcatgcattggagaaggaaatggcaacccactccagtactcttgcctggcaaatcccatggatggaggagcctggtaggctgcagtccatggtcactaagagtcggacgtgactgagtgacttagcagcagcaccagcagttttgtcctagcttttcttccaaggatcaactgtgttttaatttcatggttatagtcaccatctggagtgattttggagcccaggaagataaaaatcactgcttccactttttccctgtctatttgccatgaagtgatggtcccggatgccatgatcttagtatggtaaattcataaaaagaggattaagaagcgtacttcaacaagtccatgggtgaagaaagtatagtattcacctaccttttgaaagaaatgtgtttttgtatatattgacttaaacactatatacttatgttttttattttctaaaatatatgtgcagtaatacataagatctaaaaattctgagtgcaagttgattgcttcaatgtaaggtatgtcataacacacgatctacaaagtgtggtcacagtaatttaaaatatcttgagtcattcaatatttatgtttgaaaagtagttatttttactgtgacccccaataaccaactggaaaactttctacatccaaagtaaagtttctgtgtccgaatctacccttttgatcagcaaccattctctcattaacacttgtggccctgctgatttttgctctcatttgcaccacgtaaaaagcctctgccagcttcccttcctctctgttcaaacaaacaatagcttttggaacaaagaaggaaatttgcagcaggtgaaagtttagttttaatgatgcagagaccaaattgtttttaaactagaaatacgtagagaatgccaaactccctttaatttctcatttctcacaattatctattatagcttaccaaatctcttcctttgaatcaaagaatctttgaagtaaattcagaaactaaccttttgtgcctacatagcttattagcagcaagaaaaattacttttttcactgaccgtgagctttttctccctctggaacataaaatagagacataaacttgtaggctgtagaggcagccaccggtgacatttacatatttcctcagggagggaaaatctaggggcgaggggcttgaaaaagcctgagattggtcatttgtatccacatgtcgcaaaggagttattaggcgctgatgagcagctcagatcagaacacgcaaggctgtttccagctccttccatgccttgcagtccttggatcagggcattaattggtgtgtaaaaagtcaccttaacagggtttactgtcacctttcctgaacatccttctgatgaaggatttgtaaaaacttttctaagcaggcatctcatgtcgtttagctactccagaggaagcagtgtcaactttcgtatcgagtcattcctcagtgtccacagggcattggttccaagatctctagcaatatgcaaataccagggatgttcaagtccctttataaaaggcataggaaggtgggtgacccccccacccgcagagtccccttccatggatatgagggttgagtacccacggtcattcctactctttgaagtctctttcccactaaaatccagaggtagcagaaaggatggcgagaccagaaaggagcaggcagggatggtattagtcaggctaaatgacacaaactgctgggccaaagggtatgtttatatacacttaaatattttaacagtaccgcccactagctctcttcggggattgtatgtgagtttagttgctcagtcatgtctgactctttaccactccatggactgtagaccgccaggctcctctgtccctgggatttttcaggcaagaatattggactgggttgccgtttcctcctccagagaatcttccccacccagggatcgaactggcatctcttgaattggcaggcagattctttacccgctgagccatcagggaaacattctcaccacgcttatttaggagtgccttctctcccccttggagaaggaaacggcaacccactccagtattcatgcctggaaaatcccatggaccgaggagcctggtgggctacaatccatggggtcgcaaagagtcagacacaactgagcgacttctgtgtgtgtgtttgtgtctctcccgctaggcctgcctagcagagtatttcaaaattcctggattctttttcttttcttttttccagcaaaaggaggtttatttaggatcagcaaagaatcacaattcagggtcttcaaccacggtgagacccatgcaggtccccagcagacatcacggatttttttttttttttcaacctgttaaatgagaaagggctgataccaaagtttctgcaaagcaagtgcctcactgggatatttctcttccctttctctctcacccctctctctccttctccttcctcgtctcccttcatctcctcttcttcctctcccccttctccttacatttactgtgctaaaatacacataacaaaatttaccgttgtgatcatttttaaggttacgtttcagtagcacaaaccacatccttgagctgctgtcaccaccctccacctccagaactttgtcatcatctcaaagggaaactgcgcttgtttaacagccactcccattcctgaatccccgccagcctccggcaaccaccattctactttctgtgtctatgaatttgtctcttctacagtatttgtccttttgtgtttttataattgggcttccctgatagctcagttggtaaagaatccgcctgcaatgcaggagaccctggttcgattccagggtcaggaagatcccctggagaaaggataggctacccactccagtattcctgggcttcccttgtggctcagccggtaaagaatctgcctgcaatgcgggaaacctgggttgggaagacactttttattgctatcattattaattatttatttggctgtggggatctttgtcactgtgcgtgggccttctctactcgcgttgagtgggggctactctctagttgcggtacgagggcttctcattgtgatggcttttcctgttgtgaagcatgggctctaggcacgcaggctcagcagatgcagctcactggctctagagcgccgactcaatcgttgtggtgcttgggcttaattaccccacagcatgtggcatcttcctggatcagggatcaaatctgtgtcccctgcattggcagatggattcctaaccactgggccaccaaggaagtcccattcttttgttttgccttctttaactgttttcaagtttcatccatattgtagcatggcgcacaattccttaataaggctggataatattccattatatggctagatgacattttgttcgtccattcattcactggtgaatgcttgagttgcttccatcttttggctattgggaatgatgccgctctgaacactggtgcgcaaatatctgttttataaacattggtgtacaaacatctctttaagtttctgctttaaattcttttgaagtggaattgctggatctgtgttttatttttggaggactccccaaactgctttccacagtggctgcatcataatgcttctttttagatccaaataactgatgttgggagaaggcaatggcacccactccagtactcttgcctgggaaatcccatggagcctggtaggctgcagtccatggggttgctgagggtcagacacgactgagctacttcactttcacttttcactgtcatgcattgcagaaggaaatggcaacccactccagtgttcttgcctggagaatcccagggacgggggagcctcgtgggctgccatctatggggtcgcacagagtcggacacgactgaagcaacttagcagcagcagcagcagcaactagtaacctagtatgtgggcttccccagaggctcagtggtaaagatcctgtctgcaatgcaggagatgcagtcttgatccctgggttggaaagatcccctggaggagggcatggcaacccattccagtattcttgcctgaacaatgccacggacagaggagcctggcaggctacggtctacagtctgacaaagagtcgggcacgactgaagcgacctagcatgcacgcagcctagtatgtacccgggaccttgactccagtgcaagcatccagacttccctcatgcctcctcaggtacacatcaggcactgtcaagtctcatctcactggattatttgccagttctctaccccttgctacattctctgcctaaaatagtctttcttcttctgcatctggcaaagcacattcatccctcagcacctccatcaaatgtcacttcctctctgaagcccatccggattggcttcccttgttttagcatttatcccactgtatcctagttagtggctcacgtgtgtgattatctcctgagagtgtgagatcactgaaattattttatttgttctgcccactccagcccccctccagcagtttttggcatatacgaggtcctcagttaacgtttggtgagtgagtgaggatgctatgtgtgttgcgtgtggcatttaccttggtattcagttcagttcagttcagttcagtccagtcgctcagtcgctctttgcgaccccatgaatcgcagcacacccggcctccctgtccatcaccaactcccggagttcactcagactcacgttcaccgagtcagtgatgccatccagccatctcatcctctgtcgtccccttctcctcccgcccccaacccctcccagcatcagtcttttccaatgagtcaactcttcgcatgaggtggccaaagtactggattttcagcttcagcatcagtccttccaaagaaatcccagggctgatctccttcagaatagactggttggatctccttgcagtccaagggactctcaagagtcttctccaacaccacagctcaaaagcatcaattcttcggcgctcagccttcttcacagtacaactctcacatccatacatgaccaccatagcctccttcttcatatgggcctcacctttttcctccagcacctaatagctttggaatggattgatctggttaatattttagttttcccctttgtttcccaggcaatggtaaagaatctgccttccagtgcaggagatgcaagagacacaggttcgatctcttgatcaggaagatcccctggagaaggaaatggcaacccactccagtattcttgcctggtgagctacaagtctgtagggtctcaaagagctggacatgactgagcactactacgaatacctttaccacaatccctactcccaagtggctacagatagttgttttagagacagatcatactgtgatgggagaaggcaatggcaccccactccagtactcttgtctggaaaatcccatgtatggaggagcctggtgggctgcagtccatggggtcgctaagagtcagacacgaccgagtgacttcactttcacttttcacttttatgcattggagaaggaaatggcaacccactccagtactcttgcctggagaatcccagggattggggagcctggtgggctgccatctatagggttgtacagagttggacacgactgaagcgacttagcagcatactgtgatggacccataagtgcttgatgttcttgtttcctgcatgctgttcaggcaaaaaattgaggcagcatcccacatttactgccaaggatgaagaggaaatgtccagatttagaaagtctgattagcacaaattgcctcacaagccacccttggcctttctgttgtggagtgtttggcacatgagggtttgtttctctgatcagactgtgaaaccccatgcctttccggggactaacaagcaaacagcctgggaacaggcacacggctggctggccgcctaccacgactcttccttccccgtgttgtcagccctttgcctgatatctgagagtgagacctctggatggtcgcggtgacctgtttgctccgatcttgctgagaagtcattagttaaacctctgcaaaaagagcaaccacttccctgggagaagagctggagtcgttaaaatttcctctctgaaatgagagccaatgttggatacagagatgaaaaagctttgctacggaaattgttcttgtggttgttatttagtcattcagttgtgtctaactcttgtgaccccatggactgtagcccaccaagctcctctgtccatgggattgcccaggcaaggaatactggagtgggttgccatttcctgccccagggatcttcctgacaaagggatcgaatccacgtctgctgccttggcaggagaggtctttaccactgagccaccatctttgctatggaagatgcttattaaatcctgagtccaaataaggagaaatattaaaacttgcaaatgaaaaatacttggtgtcaacatatctttccagcatgtctcaagcagtgttttcccgggagtgttgttaatcagccctctgtcactgaaccaaacttggatccagttgcccgctgtattgatagtaaagccaatctactgacaccaagctgtggcaaaggaaagtgcaggcttgctgcagcccaagtaaggagtgtgggcacctcatgctgaaaagacctgaactccccaatagctttcggggaaaagtttttaaagacagggtaaaggagaggggggtggggtacatgataagctcgtggacattcttctaactggttggtggtgatgtgatcagtggtcagtatcatcaaacttctggttccaagcagtctggggtctatgtgcttgtatgtagcatgctgttagctaacttcttccacctggtagggtttcagcatctgcaaagcagttcaaagatatggctcaagacattatctttggctcttgaggaggaactaatgggacctgactttaatagccaaagtattgttattttgtctggtctgactctttgcctttgtttctgcatttccccacttctctgattaaatttgctctttgaaacttggggaaggcctggaaggctaaggtttttctacaaacaagaggtagttggagaacaggggttgagggggaatgttccatggggttctactaggtttcaagtgcttaagagctgatatatgcaattactggcttcccttgtggctcagctggtaaagaattcgcctgcaatgtgggagacctgggttgggaagatcccctggagaagggaaaggctacccattccaatattctggcctggagaattccatggactgtttaggccatggggtcgcaaagagtcggacacgactgaacgtctctcacttttactttatgcagttattgagccagtgcgtgttctagagaccttgttagaacacactctgggaattcttaataatgtttaaatactttgtctcacctaccacacacatgtgcgtgcgcacacactcacacacacacgcacacacacgcacacactgtttgatgagccactgggcaagataattaacgcttagtccaccccaaactgccacttgtccgggaactgcccttcatatctttcgaagtcccatgggagccacgtgtttctaccaccccctacccaacagcctcagatgtctgttctcgagtggctcttgactcaaacggaccagtgtctccctgccccaagatgtgtgggtctgagacccaggctcagctcagcgaggcttcatggccacagctaagaaatgtgaagccgtcagggatcacgtctcctccatgagagaagagagaagcagagacaagagcagagggagactcctgggactcgtggggcccctggaggcagttgttcctgataagctctgtccctcctttctgcatcttgatgggccaatgattctatagatccgtgagcccctccagggcccgctgctttgttttgtacaacctgcaaactaagaatttccatcttttacattgttgaaaaaaatcaaaagaataaaatgtcttgtgacaggtgggaattataagccttcagcactgctgcgtctacagcccctccccagctgggtccgagccacacatttccacccgtcttcacccccgtgttcagccttcttactccaactcaagaaggatgagtcagccagtgaaagcctggccttcaagttgtcctctttgaagccaactctttcctatttataaaatgcactatttataatcctgcatcctaattcatattttctataccatattcatttcctatttgtaaaattccaactgccttatcaccaccatccttttcatccttaaagaaattccctgtatatatggttgactccaaggcttcccaagtggcttagtggtaaagaatctgcctgccagtgcaggagacatgggttctatccctgggttgggaagatccccaggagaaagaaatggcaacccactccaatatccctgcctgggaaatcctatggacagaggaacctggcaggctacagtccatggggttgcaaagagtcaaacactatttcacaactaaacaacaacaacaaatcctcagctccacgcacaggggagcatcagcttactccttggactttcacggtactcatgacaataccgacaaccctcagtagcttaggggagcaagaaaggtaggagtttcatctagatcctaaatacttaactgtggccaatgcatcatgaatatgcagaataaagctcttaaaacattcttatttctcttaattccaaaagcatgcctgtaccctgcttttggctcagacagtaaagcgtctgcttacttatgcgggagaccagggttcgatccctgggttgggaagatcctctggagaaggaaatggcaactcactccagtactcttgcttggaaaatcccatggatggaggagtctggtgggccacggttcaaggggtcacaaagagtcggacgtgactaagcaatttcacttcactttacatttactttaccctgccttttactaatcatacgctttatttttaaatttttattggtgtatagtagatttgcaatgttgtcagtttcagatgtacagcaaagtgattcagttatacagatacacattgctgttgttgttttagttgctaagttgtgtctgtctctttcaagatcctgtggcctattgtccatcaggctcctctgtccttgggatttcccaggcatgaatactagagtgaataccattgccttctccaaaggatcttcctgatccagggatggagcccgtgtctcttgcattggcagatggattctttaccacgagtcaccaggggagcttcatacatatacaaatgttcactcttttttaggtttttttcccatataggctactacagagtgttgagtagagttcctgtgccatacactagctccttattaattatctattttatatatgtatgtgtatttaaaatggtgtattttaaaaattttttgtgtgtgtgctacttctctgttcaagtgcctgaagtcctctccaaaatacatcacatattatttacattctttgaaacattctcaaatatactttttttttatgggaaagaagaatttttttcttttttttctcattcaagtatatacaatatttcattagggatgatgaataatattgatgttaagccctccttcccgtgaaagtatatatttaccaagatttctgctcttctcatggcataaaaacatgtccctggcagatatttgaaattttagtcccctaaccctgcacattggagaaggaaatggcaacccactccagtattcttgcctggagaatcctatggacagaggagcctagtgggctacagtccacggggtcacaaagagtcgcacacgactgagtgactaatgacaactttgcacatgttcttaaagcagatgaaaaacaaatatttacccttggttgcaaatatgtcattaggcttcagtcaatggggcattaggttaaggatggatctcttctttccgaaactcattgtgtgccctacagaaaaccacacaacctctctggtgtcttattctgacctgtgttggtgtttcattggggaggaggagtataattgctttacaatgttgtgttagtctctgccgtacaacgaagtgaatcagctctatgtatgcatatatccccttcctcttggcccaccccccaccccacccttctaggtcatcacagagctgagctccctgtgctatagagcagcttcccactagctagctatgttacacatggtggtgtatatacagcagtctcaatctcccaaatcattcccctctcgctttccccaccgtgtccacgtgtacagtctctatgtctgcatctctctccctgtcctgcaaataggttcaagacagggaagcctggcgtgctgcaggccatggggtcgcaaagagtcagacacgactgagcgactgaacaacaacaagatgccatttctctagattccacatatatgtgttaatatacaatatttgtttttctctttatgatttatttcattctgtataacagactctaggtccatccacatctctacaagctttattttgtttaaggtgcatacgtgcatgctcagtcatgtctgactctgcaaccccatggactgtagcccgccaggctcctctgtccacaggattttccaggcaggaatactggagtaggttgccaggtaggctggattaaatcatctctgaggtcaattttggctcagactctacttctctaatcactgttctttccctgatattctgtgatattgtggatatttgtcattggaacaggtgtccagacaaggtccatggatggaacataaatgcattcataaggagatgttggcgtggtgacactggattctgttctgacccttttcaacaaatgggtatttggccccctccacttcagtatttgtcttcatggtaaaaatctagctctgagaaatgatgctaaatccacaagatcttgtctatgggacttgtcagggggacaaagatggagttacctagtgctcagtaatccacgtggaaataaaaaagattaagcagcacagacactgtgaccactgagaaaattacagaaacaaagatcattacatgcatctggttttccagggggaagatgtggagataaagccctaagtctttaataaggctagaaattaaaattgggattaacgacaacaagaagcatttataagaagtggcacacagtactcccgcttaagttttcctggcctgatttctggaaaattttctatggtgtaaaatgtatcatcagcttcctctctggttgaaaaacaatggtcactggccactggtttcaggtccctgggctttccctagacatacttgttctgctttagactacacttctttaaaagcaatgatttaaggacttacctggtgatccagtgttaatccacctgccagttcagggacacaggttcaatccctggtccagaagctgagatcccacacgctgcagggcagctgagcccatgcactgcaaccagaggagccatcgcaatgagaagcccgtgtgccacaactagagattggcctccactctccagtggagagagaaagcccttgggcagcaatgaagacctagtgcagccaataaataaagcttctttaaaaaataaataaaaggaatacaatttagcgctgtttctatgaggcttctatagcaatgagggagtatgaatatcttgactatcaatagagctttgaggtctggcctcgtcctgtgatactctgaagaaaacagctcccaaaggaagtgattgaggggaatacagcctggcctgggtgtgggagaggggagaatggactccctccaaattaaaaggctcgtatcctcctattggtggtgcagaagcctctgttaaatgtaactgtgccactcagatgaccaactgttatgagttgaattgtgtccccctcctagaaagatatgtggaagtcttaaccctcaggacctcaagatgtggccttatttggaaacaacatctttataaaggtaatcaagttaaaatggaatcgttagttagggtgagtcttcatccaatatgcctgatatccttataaaaaaggagaatttagatacagatacacacacacatggctccaaaatcactgtggacagtgactgcagccatgaaatgaaaagacacttgctccttggaaggaaagctaggacaaacctagacaacacattaaaaagcagagacatcattttgccaacaaaggtacagatactcaaagctatggttcttcccgttgggctttcctggtggctcagctggtaaagaacccacctgcaatgcaggcgacctgggtttgatccctgggttgggaagatcccctggagaaggaaatagctacccactccagtgttctggcctggagaattccatggactgtatagtccatggggttgcaaagagttggacacgactaagtgactttcactttcacacttttcaccttatgtatgggtgtaagagttggaccataaagaaggctgagtgctgaagaactgatggttttgaattgtgctggagaagactcttgagagtcctttggacagcaaggagatccaaccagtcagtcctaaaggaaatcaatcctgaatactcattggaaggactgatgctgaagcttcaatattttggccacctgatgtgaagagtcaactcattgaaaaagaccctgaagctgggaaagattgagggcaggaggagaaggaagcggcagaagatgacatggttagatagcatcactgactcagtaggcatgaatttgagtgaactccaggagataatggaggacagaggagcctggcatgcggtagtccatggggtcacaaagagtcggcacaacttacagactgaacagcagcaacatacacacacaaacagatatgcacagagggaagagacagggagtatgccctgtgaaggcagaagattggaggataggtctgcaagcctaagagcatcaaagattgatggcaaaccatcacagtctgggaaagaggccccagcaccaaccctgacctgggatgtcccagtttggggagcagcccccagcccatgggtagcaggacatggactcagaattacagtcagagaaaagcaacacagagaaacaagcttgtttgaatgtacaatggaatattgaacttcctgaagaagatgcagtctttaaaaaaaaaaaaaaaaaaggttagtgttgtccatatattgggttgggcaaaaatttcgttcaggcattttctaagatggtatggggaaaccgaatgaactttttggccaacccattatatttctcataggtcatgggaattacatttctttaatattaagacatgatttgtccctacttgctgggtgatcatttactgaaactgaaagattcactgctttgcgaagagaatggatactgctcagaagagacatcagcagtttgctgaatgtttcaaagtaaatttttaaagatccttggtgaccagctggggaagaacaaacacttgaaagccaagttttcaaaggagaaagcaaatggggttcttagcattcccaaggctgtgttttttttttttaattttattttatttttaaactttacataattgtattagttttgctaaatatcaaaatgaatccaccacaggcatacatgtgttccccatcctgaaccctcctccctcctccctccccacaccatccctctgggtcatcccagtgcaccagccccaagcatccagtatcgcgcatcgaacctggactggcaactcgtttcttactgtgttttatgtaacaggaattaaagctttgaagaaaggctgcagagtaggtcatgatgtgtgggctatgacataagggaagttcacagcccataggaagaagaaaggcccttctagaaccttaaaagaattctgaggggatgagaggaggagcctcaagaagcacttggcacccacatcctgccaagtctgggcagccaagggacgggcaatggcagaagtactcagacagagccaggggaatctgggtacctcgggagaaaggggaatgttggggcagtgtgattcccaggcaggtgattagcagggtctgagaaaggaggagcaaaagtgaggacctgagctaatccttcattcacacccctgagtgtagcacatgagcaaggtgttcagaagccccattcatccctgtgggcttgcagaagtgcagaggctattcgggggcaacacaagagtggagaccatgacagggtgacttttgactgtgggaaccttggaagcagggactttcccagcaatcacagacgtcagcagcaagagtcagccagcaggcgcccaagactgtcacagacacaattcccctgtggttgtcctttagtaggtaagtcatgtctgactctctgtgaccccgtggacggtagcctgccaggctcctcagtccatgggagtttccaggcaagggtactggagtggggtgccttttccttctccaggggatcttcccaacccagggatcaaacccatatctcctgcactggcaggcaggtgcttttccattgagccacctgggaagcccacagctcggtagacccagctgaaatgcctgtaagcagaagagatgatctgggacttagagaagtccagaaagacagaagatggagaaagagtagatgctgtcagtcctatgctgtgagactgggagctatctctgaccatcagttattcctgtgggaaaatgaggaagaaaaagaaagtagggagaaatccaggaaaactatttacctgaaagtgaaagccactcagttgtgtccgactctttgtgaccccatggactatccagtccatgaaattctctaggccagaaatcctggagtgggcagcctttcccttctccaggggatcttcccaacccagggatcaaacccagttctcccacattgcaggcagattctttaccagctgagccacaagggaagcccccatttatctgaaagagtaatcaaaagaaagtatttaaacctgaaattatcaaatgatgatttaagtattatattagctcaaggtgccataacaaataaccagagaccaggtggcttaaagaacagaaatttatttctcatagttctggaggctgggaaatccaagatcaaggtctggcgaggtgggtttcattctgaggcctcttcccttggcttgcagagggctgccatcctgctatgcactcatatgacctctttcctgtgcatttgaggagagagagcagctttctggtatctcttcttatgaagaagacatcagtccagtcagaccaaggccccatccttaccacttcacttaaccttaatgcttccttactccaaatacagccacacaggcagtcgagcctttgacctatgaactggaggtggggggctgggggagacacaaatatccagtccataataggtagcaaatttaagtgttttcttctcccaagttagataagtggctcaagatcaagtttatttccattacagagaggtgaaccaagtttctctgtttatacctgcaaaaacacgtaaatatcaagagtgggcttccctggtagctcagtggtaaggaattcacctgccaatgggagagatgtggattccatccctgggtcagtaagatcccccagagaaggaaatgacaactcgcttcagtattcttgcctgggaaatcctgtggacagaggagcctggtgggctatagtccacggatcgcaaaagaatcagacatgacgtagcggctaaacaacaagaaatcatgagcgtatatatttcatatataaactatttgaggatttatacaaaatgttagcgttgagtttcattaggaaatggccttttctgtgatttgtatttgattattttcacacacctgtgtttccatatttaacctgcatttcttttataataagaaaaggtacatataacactagaaaataaagagtcactatcctccaactatcaaaatttggtaaaaaaaaatgataagcatgataatatttaatcctggaaagattggggaaatgagaacttccatttcttactggtagaaacatgacttgttctagtctttctagtgggaccatgtggtaacatgtatgaaaagccttaacatgtgcatctgttctaacttagcaattccacttctaggaatttattctttaaaggtttattctagggaacataacacgtatagcgacttatacaagaatgtttgggacagttttatttcctagcaaaaccctaataaataattggaaacagctctccaattacacccacttccctggtggctcagacggtaaagcgtctgcctgcaatgcgggagacttgggttcaatccctgggtcaggaagatcccctggagaaagaaatggcaacccactccagtaacttgcctcgaaaattccgtggactgaggagcctggtaggctacagtccatggggtcgcaaagagttggacacgactgagcgactttactttcactttctcctattacaggggattgatgaaaaaattagatattctatactatggactattatacatcttttaaaactcaagttgtagaagcatatttgtgtttacagtatatcatcaactgaaagattaggctacaaaactgaaggggtagtattacttcatcagccacaatattactgcaaaacagaacatcccagaactcagtggcttactacacacagctaatcgtgtgctcacagtgggcaggttttctgagatttggttgatctgggctgggctctgctggatggctcttcttcaggccagggcagtgggatgggctctcagctgaaggttgggtcaggtcaactccttttctctctcatcactccaggacagccgcctccaggggcacattcgcagagtagaacaagccccacccacaaccacattcaaagcctctgctcatttacatccacctgcatttcagacctgagaaagtccacggtcaagccttgtatcaatgagtcaaggaaacactgggtgctgtggagtgagaggaatagccaggtggcatggcaaaggaaatgggtacatgaaggggggaagaactgcacataaggttaccgtcttccacttctgatgccttttaaaaaataaatatgccatatctgcctcctggttatctatttgtgaaagaatctttttcaataagaaatgggttttgtattgagcgacagaaaacttgactatgccttaaaaagtaaaattttcttattttaattttcttattggaacgagcagaccagatgcaggcaggctaataatgttatcaaggaggcaggctcatctgtcattctgaccaaccatcttcagcaggtggtcttcatctcaagtcacaagatgcctgatgccctgaagataagcatgtacctgttccccaacccttgaatttttcagaagtatcagcttttgtttacgtggattaatgtggattttttttttattaatgtggattttatctttaccttggtggatacaaagagttgctgaaaattgtatttttccttttttgtctcttttgtaaagaaataccaggtgtccaggattaataataagaactgttgattgacacattgtctagagtcacccaacatttttacccagttctgatgtcagtttctctgaagagattacccaacccacttgcttccccttgcagccacatcagcagcaactgcaacttaatactcatggctagcacagagttcagttataagcagtctttccttataaacaaaacaaaaggacacctccaatatgtttgcaattttatttcttgctgggaaaggcctggtaaaatgtctcttgtggcatagctggaacaaaaaagaaccccatcaaaggcagggaggccatgggggtgccaacacaattaacttcagccactggggctttcaagttaaggaagctgattgtagcaaatgtctctttgcagaactgccaacgtattagagatccaccagggacctggcacgtggggaggctgtcccaaaggctggaaagtcttgcctgacatgaacttagaatcaagtttggtgagtttctactccaatgagaatcattattccctagttaactttttaaaagaaactttaagtcattcaggaacaaaaagtcgtagggtagagacttcagagtttgttctttatgcttataacctacgaggggaaaggactgtttcatctttctgttacttggttaatgtaagagccaatcctccttaaatacacttctctcccttattctctccctctcagcctctcttcctttcttctatgctgacagcactccttgataatgctaaatacctgcatcttaagtctactgctctttgaattttgacaaatgtgaacctgaacccatacaactatcacccagtgcaagatagaaaacatttccatcattctggaaaattccctcatgcctctttccaatcaccaaaccctattctaatttctatcaccataagctagttttgctgctcttgaacttcatactaataaagtcataaagtatgtattcatttctgtttgacttcttgtgctgaactattatttttgattcatccattcagcaggcatcaagaatttgtgccttttgattggtgagtcatatttcattataaaagtattccataatttgtttatacactctctggttgatgttcccaattattatgaataaagctatagtgaacattcttggacacatctttttatgaaaactgtattcatttttcttgggtgtgaatctagaagtggattttctgttgaactaaatttttactgtttggtgttttcaccaatgacatacagttgccaacactatatattgtcagtcttgtaattttagacactctaatgagtgtgttgcagtatctcattgtggttttaattcattctccctgttacctaatgatgctgaacacattttcatgtatttcttggctacttaggtatctccctttaaaagtgcttgtttcaagacttttgtccactttttattaattgggatttttattattggtttgtaggaactctttatttattctagatgaagtccgttttagacatatccttcttgaatattttatcccaacctgtagcttgacttttcactctcttgatgatgtttcttttgatgagaagtttttaattttggtaaagtccagtgtactaatgtttgcttttgttggtagtgccttctgtgactttctaagaaatctttgcctgcccacaaagtgcagatatttttgtatgttttaaaatgttccacttcaaattaatttatatgtgcagtgtgaggcaggagtcaagtcttgttttttccctctgccaatatctagttttccaccatttgtttctaacatttactgacatgtgatttgtttgcctttccacattggattgctttgacacttttgtcaaaaatcaattgaccatgggtctatatgtcacccaggaaccactgtgggtctacttctgggctctttatcctgatccattaatctattttttatccttatagcaatagtacattttcttgattacaatagctttttaataagtcttaaaattagcagaactcctccagatttgttcttctttttcataattgttttggcatttgggatcctctgtaaatattttagaatcagcttattcagttctagaaaaattcctgctgggattttggttgggtttgcattgactctatagataaataagaggaaagctgacatttaacatactaaatcttccaattcatgaacatgatatatttcctcatttatttaagacttctctaatttgtctcagtaacatttataagtttctgcatagaggtttgcatatctttcagttcagttcagttcagtagctcagtcgtgtccgactctttgcgaccccgtgaattgcagcatgccaggcctactcccggagttcactcagactcacgtccatcgagtcagtgatgccatccagccatctcatcctctgtcgtccccttctcctgcccccagtccctcccagcatcagagtcctttccaatgagtcaactcttcgaatgaggtggccaaagtattggagtttcagctttagcatcattccttccaaagaaatcccagggctgatctccttcagaatggactggttgaatctccttgcagtccaagggactctcaagagtcttctccaacaccacagttcaaaagcatcagttcttcggcactcagccttcttcacagtccaactctcacttctttagttaaactttagttaaacttaaatctattcctggtatttgatccttaggttactttaggtagtgtattttaatttttccccattatttgttgcctgtatagagaaatacaatttaatctttatccattgaccttttatcctgcaactttactaaaaaagtctaattgtagattcctttggatgtttcatgtacacaatgtcagctgtgaatacagataattttccttctttctttctgatatttatgccattgatttcttttttaattaatttattctaattggaggctaattacaatactgtagtggttttcgccatacattgatatgaatcagccatgggtgcacatgtgccctgcatcttgaaccccctcccaacaccctccccacccatccctcagggtgtcccagtgcaccgtacgccgctgatttcttgttcttgtcttcctgcgctggtctgcccttgactgcattgtagaagtgatgacagtggacatccttgccttgactgtagaggaaaagcacccagtatcttaccattaagtgtggtattagttctaagtgtttgatagataacccttattagagaggaagtttccttgattttctactttgctgagaccttttgttgttactgtgtttttttttaatagaataaaatgggtattgcgtttcatcaaatgttttctttgcatttattaaaatggtcacaagggttttcttcttcatgacattgatttttcaaagatagcagattttccataccatggataaacctcattttgtcaagttgtattcttctttgtatgcattgctgtagtctgtttgctaatattttgtttgtaattttggttaacttcctgaagcattctaatctgaacaataatctgtcttcattctgtaaaaatgaaggcccccacatttctgcctcaatagctgcactgttgctaaacaagcttttgatgaattactgatttttataaaccatttttattcttctgtgtgaaaatttataaagtaaaactgaatggaattttaccatagcacaaatacaagtgtgtagattgcagacactttctgtgaaactggaatcatttaaaagctgcaatagaaatcaattctatctctgtggatgtaagaatgctctagaaaataaagttttttattttctaagaaaagagagaaatgttacaagcaaacagaaaaacaattctatttgatatagaaaagagcaaaatcaaatgctataatcactgttaactgagtgaatattagggaggctgaccctctattcctcacaatgatgcttgttttcatcaattgagcatcaatgcaaaaatcctaaagtgaacatttttaatcctgggattacgaattgtccttttataacctaggaaccaaaattatctatgaaatgtgtgccatgagtttagggaaaagaggaaagaaactcctctgtctcacatcactgccaatctcatcgcccccagttcccagtccagggtcagccccacccaagtcctttggtctctgagttaacacagcaatctgctgtgttcaagggtggactcagcacgggccttctttctgccctaaagtaaggtctcttgtcccatgtcccacgtcaagggacctcagctgcaccaagccctaacaaccatccccttggagtctcttctcccagcatgtccttccctattttgcatctggaggagaatcaggtaaaggacccctctaagtcccaaagtaacccaccttgggaaacgaacttttctaaactgagtgttcaagcaggcgaagctgggttaggatgccttggttctgcaacccaaacctctcctctcctccaccctggtcaggagtggacctgctcccaggtaacctatgtccatagcccattgtcagacaaccaaatgaggctcagagattgagaaaatgagcccaaggatgcacggctggtgagtagccaaagtaggactgagagggtagcctggctccggggtccaaggtcttaactttatcaaccgatcacctctgtatgtatgtatctatcggtcatctgtttaccatctgtctatttaactagcatctatttttctatcgatctatctaatatagaaacacagattcagttgagtattgctgtaaaagtgagagtcagggctttcccccctgtctccctcacatgcatgtattattaagctggaaaccattctaggcactaagatacaatgagaaaggaagcctcagtctggtaagaggtgcagccatgtttgctcttgacaaagagagctcagctcaacattcagaaaactgagatcatggcatctggttccatcacttcatgggaaatagatggggaaacagtgggaacagtatccgactttatttttttgggctccaaaatcactacagatggtgattgcagccatgaaattaaaagacgcttactccttagaaggaaagttatgaccaacctagatagcatattcaaaagcagagacattactttgccaacaaaggtccgtctagtcaaggctatggtttttccagtggtcatgtatgaatgtgagagttggactttgaagaaagctgagcaccaaagaattgatgcttttgaactgtgatgttggagaagactcttgagagtcccttggactgcaaggagattcaaccagtccattctaaaggagatcatcagtcctgggtgttctttggaaggactgatgctaaagctgaaactccaatactttggccaccttatgcgaagagttgactcattggaaaagactctaatgctgggagggattgggggcaggaggagaaggggatgacagaggatgagatggctggatggcaccaccaactcgatggatgtgagtttgagtgaactctgggagtcggtgatggacagggaggcctggcgtgctgcaattcatggggtcgcaaagagtcagacatgactgagcgactgaactgaactgaaagagggaactgctgatggccaggatatgggttcagggacaagcatgctagagaggaaccctcaaagacagaggctgagagaaaggaaggaaccagaggctggggggaagataaaagatccagtgtggctctgcgcccagtccctggaggtgagggaggtggggcagaggcagggagaaatgggatgaagggcggtgggtaggaagagagtgggagtgagtatcagaatgtcctatgtctgtgactccagaggaaggaagggagtaaggagggagggaaagggaaagggaaagaagaggctgaaaagccaaggtggttcatgttttgaaagacgcagtattctcataaaaagtttgagcttttcattgtcaatggggaatcatgaatggcttaatcaggtacatgataagcaatacttgactgaatctgcatttctatattagatagatagaaaaatagatgatagctaaatcagttcagttcagtcactcaatcatgttcaactctttgcaaccccatggactgcagcatgccaggcctccctgtccatcaccaactcctggagcttgctcaaactcatgaccactgagtcagtgatgccatccaaccatctcatcttctgttgttccttgctcctcccgctttcaatctttcccagcatcagggtcttttccaatgagtcagttcttcgcattaggtagccaaagtattggagtttcagtttcaacatcaatcctttcaatgaacacccaggactgatctcctttagaatggactggttggatctccttgcagtccaagggactctcaagagtcttctccaacaccacagttcaaaagcatcaattcttcggcactcagctttcttcacagtccaactctcacatccatgcatgactactgggaaaaccatagctttgattagacggacctttgttggccaagttatttagatagctaaatagataaatgataaacagacagttgataaacacatacatacatagatgattgataatggatagatatctaagtacatggatacacagatagatgattgactgatgatagacaggtaggtagataagagaaagatggagtaggagatagcgtgagaatggagaaagatgaagatgggatggggggtggggataacgatatactttttcccccagggagttggaggtgggggttgaaggcactaggagtggacagaaagtaggattatttgttacatttctcctcctcccactgttgcacgaatgcatcaggtcaaagagtcctgtcccttgcacagctggagcccaggcaacagagaatgagggcggcgagggctggcccgaagaaacagccacttccgatgaatgaatgcccagcacctaggcttagatcaccgaccagacagccagacgcactgagaacccagcagatcatcactactccaaaagcccctccgtgaaaatgagggtctccagccctccttggtcctcttcagacccagccagatggatctaagcattgttaggaggggacgaatctgtaggtagccaccaccttgccccccagctgactcgcaaagccaggctccggctgcgaggggcagagccaccctgggagggaaatgaccaaggtcgatgctggggacgcagcatctgcagcaatgcatttgcccctttcttctcctgtggtcattgttactttccactgaccagctgcctgcaggctctgggcggagacagcatgggtaacacagcctccattcatcagagattaatgcctgaaatgagccacacctctgaacaattgcttcctagaagagggagggcgctgaatggccagggagccccattgatgactgttataaaaaagaggtgaaggcctgcatgggaggaaagaacagtttcacactgcctcccaaacctagctccgattcttccccatccctcctcttttcccttctgcccgtccttttggcctatttgcccttaatccggacgcatccttttttgtctagggactcaggccaccggctgaaaattcacgggtttgctactgtaagtcatatcatggtggctgctgccgaccacattggtactattatctgtgcaactttccgacttgacaattagttactatcattcacattgtgcagtcagctgttaaatcctcatttatgctcatttgaatatgaatgtgctgttcaataacatgttagattgccatgtttacaaatatactccaggtatttagaaatttagatgatgcaaaacatactgtttaagctgcgctcggtgccagtttaaataacttaagcctatttatcagtcacttagcaattcttttcacatactcctgttttcctgggtcctacccttctcaaccaaaactaaaatatgctctctttctgtgggtttgctttgttgctgtattaaactaataatcttcaagatgggacttaattagcagtcacctctactgtgggtcttcctttctaattcccgctgatctaatttctgcctcttttagaagtaggtgaaagagtaaatgcaaaaaggaaagaaaaaaaaaaaagatccctgcagctgcaatgtttaaatatcaagtctctgaaagcaaatgatttgtatatatcgatagcccaaagaggagggaagagaaaatttttgaatggaggtacaacttaagagagcaagatatacctagtcataaactcctgggaagaagcattgtacacgcagaacaggggcttcccgggtggcccacacggtaaagaacccacccgcaattagacgaaagagatccgggttcagtccctgggtcagggaagatcccctggagaagtaaatggcaacccactgcagtattcttgcctggagaatcccatggacagaggagccccacaggctacagttcatggggccacacagagtcagacacgactagagcgacttagcacacacacacagagcaggccttctcagacttgatctgaggcacctggggattccctaggacttgatctggttcaggaagtagggctgcggccaggatacttgaccatctcccaggtgccgctgatgctcctatgagaccacgtatcagagcgggtagcaaggctctgaaacataacttatacatccatcttcaactattctccttacaataaggacacacatttccattaagagatttaaggaccaaacttgataattccacttctgatatatcaaaaaaaaaaaaaaaaaactgaaagcagagtcttgacgaaatatctgtataccccggttcccaataacattattcatgatagccaaggcagggaagaaacacaagtgtctgactgcgggtgacttgataaatacaatgtgatatataaatataatggaatgttattcagtcttaaaaaagaaggaaattttgggacaggctacaacatgaaagaatcttgaggacattatgctaagtgaaataagccagatatcaaagtacacatattgtgtgattccacttttacgaagtatctagaatagtcaaactcatagaaacagaaagaatggtggtcgccaggagctgaagggaggaggaaaggggaagttgtttaatggacagagtttcagttttgcaaaatgaaaaagttctgggggttggttgcataacaatgtgaatagactcagcaatactgaactacacacttaaaaatggttaagaggatacattttatgttatgtgcattttaccacaatttttaaagtctttttaataaattggaaaaaataatcttggttttagggacattataaaaaaaattctttttctgccaagaaagctatatttcttctgttattcaattcttcaatgggcttgtcagctatcaccagccctcataccagccagaaaagaatttctcttccacgctcccatgccctttgctccaaactctatttcagtacttattacattctgatcaacgttcatattctgtgtgtgtctccacctcccaggtttcccaggtggtgcagtggtaaaaaacccacccgtcactgcaggagatgcaggtttgatccctgggtcaggaagatcccctggaggaggaaacggcaacctgctccagtattcttgactgggaaatcccatggacagaggagcctggtggggtacagtccatgggggtcataaagagtcagacacaactgagtgcacacacacacacacacacactatacctcagatcctcgagtgtgaggttttgaagaggatggtttgccctgcaactatgcggtaggcactgctggggtcccaagctcaggcacttctttcctcctccttcccgacaccatgctgattacattcaggggtctccccttctccactctgtcccctggtgtttgggccatgaggagtctgtgtcaaccctgatgctgtcattcccctcatcaacaactggctcccacgttgtcatgggccaattttgcgatcactgagacaggaggggaatctgctgagcagcttcaggaaaagatttccttgcttttaaaaagagactgttcctctaagtaggagggatgttgtttgtttagatgaaacacagggaatgaaagccaccatcttgatgtgagtcttaagccagcaccagaaaggggcagagacaaaggaatccagaaagacagagaaagagccagaaccaccctgcctttggatccctcactgtataaagaaatagagtgctttgtggtttaagtgagacgagcagggcttttctgtgtcttgcagtcaaaaccgtctcaatcaacaccactaccccgcagataggaggtactcggaaatttgctggatgaattaaaataagatgcagctggttcactgccctgaggactcctcaggcaccaacactgtcccccacgctaagcaacctcatatacgaaaaggtctttccaactagaaagatatagggagtttttgtttgttttgcttgcttgttttattaaaggattctccatgggctacttttcctagaaaacatttaaaatgtcttttgattttaccttttgacagcctgtgtctgacagagcgaagttcaggtataggtcatcaggatagcagatgcttgcgtgcatgctcagtcactcagttatatccgactctgtgcgactctatgaactgtagcccaccaggctccttggtccatgagatttcccagacaagaatacaggatcaggcagccatgccctcctgcagggatagcagatatttattgagtacttatatgccaaatgatgttgttattgttattttgtcactaaggtatgtctgactgttttgcaatcccatgttacacatcattaattttcaacagccctcggcttgatactgttaccatgccccttttacaaatgaagcaacggaggcaccaaaaatcgcattcccttgcccaaggccagcagctgggattccaacagttgtctcctgcgttatcctgtatggctaaactttggctaggtgcactgtggcactccttagttcagataaccataatccattccctacagcatggccagaaaatcttcaaactattaaaaatctccttaagactcaaagtatattaacctcctgtcagtgcccttcagtggattccggatgggtaatctagagagcattcaaaaggactgacacagcccacaagactcttcctatgctgcttgggagaaaaaggtatgaccaacctagacagcttattaaaaagtagaagcatcactttgccaacaaaggtcggtctagtcaaagctctggtttttccagtggtcatgtatggatgtgagagttggactataaagaaagctgagcacagaagaattgatgcttttgactgtggtgttggagaagactcttgagagtcccttggactgcaaggacatccaaccgatcaatcctaaaggaaaccagtctgggatatttattggaaggactaatgctgaagctgaaactccaatactttggtcacctgaaatgaagagctgactcattaaaaaaagaccctgattctgggaaagattgaaggcaaacagaatagggggtggcagaggatgtgatggttagagagcatcactgactcagtggacatgaatttgaacaaagggagttagtgaaggacaggcaagcctgacatatggtggttcatggggtcacaaaaaattggacaggacttacatttagccactgaaccaaaaacctgaaatgctcatctctaccccctggtcatttccagtcctgcccccattatcctggccactgtgaccacttttcagctcctctaacactcagcctttttatctcagggcctttgcacctgctcttcattctgcctgagctcaacacctttccccccgacacacaccttcctcctagataacttcagctcatccttcaagtctcagtgtaaacattttacgttcttagggagttctttgctgacccattaatctaagtgtgcccctcaatcatcccctcccctgtctcagcctttatcaggatggataatcccatcagtccgggtgacttgctgttttgtctctgtcttacctaaggagaggttcagctacacgtatgagggatcatatctgtgatgtcaccgaggtgtctcccatgacaggcatatcatagaaaatggtggggagatattcagggaaaggagggaaggaagctgagaggagaagaaaaagttgaaaggaaagaagggaggtgaaagggggagaagactggaaggaaggaagggatggtgggactcctctgagttacttcaagttggaaagccttgatcaccagcgctcagaaggctcagccttgttaataactattagctgatttccttcctccctccctttctatttctgtgtctagtttcctatttccatatttctttttttaaaaaaaatctctataaaacaaatttaagtgattagggatttccctggtggtccggtggctaagactccatgctcccaatgcagggggttcaggttggatccctagtccaagaactagaccccacattctgcaactaagagttcttatgctgcaactaaagatccctcatgctgcaactaagacccagagcaaccaaataaataagtatctttttaaaaagtaaaagaaaacatcaaaacattaaataggcttccctgatggctcagtggtgaagaatctgactgccaatgcaggggacaccagtttgatccctggtccgggaagatcccacatacctcagagcagctagacctgtgagcctgcgctgagtctgcgctctggagcccgggaactggaactactgaagtcctagaacgctagaccccacgctctgcagcaagagaagacactgcaatgagaaatccttgcaccacaaccagagagcactcccgctcaccgcagctagagaaaagcctgcatggcaaggaaaacccagcacagccaaaataaataaaaaataaaattattttaaaaactatccctaaagggaaatatctatgttgggctcataagatattttcaccattttttttccaatttaaaattgagaaccattaaaatagagaataccttgtgaaaagcaatacaatttctagcattttaactcattttaaaatagacaaaataaattcattctagaacatatccagctacctatgagatgagattatattcagttcagttaagttcagtcagtcagttgtgtctgactctttgtgaccccatggactgcagcacaccaggcctccctgtccatcaccaactccgggagtttactcaaactcaggtctattgagtcagtgatgccatcccaccatctcatgctctgtcatccccttctcctcctgccttcaatctttcccagcatcaggatcttttcaaatgagtcagttcttcgcatcaggtagccaaagtattggagtttcagtttcaacatcaatccttccaatgaacaccctggactgatctcctttaggatggactggttggatctccttgcagtccaagggactctcaagagtcttctccaacacccccaccacatcaattcttcagcactcagctttcttcatagtccaactctcacatccatacatgaccactggaaaaaccatagccttgactagacgtacctttgttggcaaagtaatgtctctgcttttgaatatgctatctaggttggtcataacttttcttccaaggagtaagcatcttttaatttcatagctgcagtcaccatctgcagtgattttggagcccaagaaaataaattcttccactgtttccccatctatttcccatgaagtgatgggaacagatgccatgatcttagttttctgaatgttgagctttaagccaactttttcactctcctctttcactttcatcaagaggctttttagttcctcttcactttctgccataagggtggtgtcatctgcatatcagaggttattgatatttctcccggcaatcttgattccagcttgtgcttcatccagcccagcggtttctcatgatgactctgcatataagttaaataagcagggtgacaatatacaaccttgacatactccttttcctatttggaaccagtctgttgttccacgttcagttctaactgttgctttctgacctgcatataggtttctcaagaggcaggtcgggtggtctggtattcccatcccttgaagaattttccacagtttgttgtggtccacacagtcaaaggctttggcatagtcaataaagcagaagtagatgtttttctggaactctcttgcttttctgatgatccaacagatgttgacaatttgatctctggttcctctgccttttctaaatccagcttgaacatctggaagttcacggttcatgtactgttgaagcctggcttggagaattttgagcattacttcactagcgtgtgagatgagtgcaattgtgtggtagtttgagcattctttgacattgcctttctttgggattggaatgaaaactgaccttttccagtcctgtggccactgctgagttttccaaatttgctggcatattgagttaaatttctttttcagagcactgcctagctaatataagtaaggtattgatcaacagaactctacaccactgacaccatagattgtttccttaggtttgaaagcacaaaaaaagaattgtactttaaatacaaaaaaagggggggggaaatgtcttttttctttgtttgagtcattttcaaattcatttattcagagtgcccttcagttaagagcttgatgtaacaatgagactgatgaaaggaacgaaagaagaaatctatgcattcaaatgagtattatcattcaagaatgttatctggcaattatacatttattcttcagtaactccattctcaattattttgggagcatttccattgggaactatcttttctgtggttctgtttggcaagaggtgcacaagttagaacatcactgatacatatgtatcacctgccatgataaagatgttggcttggaagggaattttcagttaagtctttaccttatggatgagaaaacagagattcagaaaatctgaatctcttgacagagacacttgacagagtcacagagctttcattcacttaaaagtcaatgagagaatgagaaaaagtatttgaatcaccacttcactgaattattcaacatatgtaactctttcttattggattccctcattcattcattctacaaatatttactgagtgcctagtatgtgcccatcactgctgaggatgttgcagtgaacaaaacagacaaagaactgcacatcttcatggagttcacactccaaggattcaataaaatttaaatccctgattcccttttccattgaaaggtcgctattttaacaattctaagaaaccacttgattagcatcaaagatgttgaacaaatgctctgttgacataatttgatgagtgtaggaattacaaatatgagtcaacttcactgattacaaagacagaagaaagtagtgtacaatcaacttttttagaaaagaattaaaccccatgaaaaaacaatgttccaacatgacatccagattcaccagccatgtctcctgaaacagaggagaagactgttaggaataagagaaaagaaaactaagcatttttaaaggctttctatatagggtaagaaaacatgaaacttttggcaagcatgaaacttttggcagctcgcagaatgaaaccactcgctgcctgcaagtgtttatcccacagctgttggaaatgaaggatgtcaaaatacacaaaagtaagactccaggcacagatatcaaagaagcaaaattccagggcatgcctggaatcaaagtggacaatagatgggactcacgaggagacacaggaacgagaggccttggaccatgaagaccagcggatcttgatatcacaaccagaatgcggcctgtgttcatctctcctgtaccatcacggaaaactatccagaccttcagaaatccattttaataggataccaggatacaagaagggcttcccaggtgccacagtgggaaagaacccacttgccaatgcaggagactcaagagacagggggttgatctctgggtcgggaagatcccctggagaaggaaatggcaacccattattcttgcctggaaaatcctacagacagagaagccaagcaggctacagtctaggggattgcaaagagtcgggcatgactaagcatgcgcacacgcacggaaggatacaaggccggtggctgttagttcattctgtacagggtgcacttatttactcagtggtgagatcatgaaaacttggtcagtacttccttttttctttccgtgttttcttctttttaaatgaaatatcatatttactgcaccaatagaaattgttattcttaaaagccaaacgatgatcttattttgggctttcctgatggctcagcaggtaaagaatccacctgtaatgcaggagacacaggtttgatccctgggttgggaagatcccttggaggaggaaattgcaatccactccagtattcttgcctgaaaaatcccatggacagaggagcttggtggactacagtccaaagggtcccaaagagtcggacacggctgagtaactaagcacaagcacagatccttttttttttttttttttctgggagacacacactgcctgctgtaccctgtccaccgcccccagccctcagccccaggtgctctgctactggaaaaggtcagagcagccatgtgggggacatagagaataccctgccctggccaactgactacaggtgcctgaccattctcggcacccagaaagctcccaagcctgggagcacctcagcaggcaccccgcccctcgtggttccatgggttaacatctaggatggtccctcggggaacaagggttatgctatgctatgctaagtcacttcagtcgtgtccgactctgtgcgaccccatagacagcagcccaccaggctcccccgtccctgggattcttcaggcaagaacactggagtgggttgccattgccttctccaatgcatgaaagtgaaaagtgaaagtgaagtcgctcagtcgtgtctgactcttatcgaccccatggactgcagcctactaggctcctccatccatgggattttccaggcaagagtactagagtggggtgccattgccttctccgacagatcctattttataaagaaaaacatttgtgtttggagaaactaaaacatttgtattttgagaagtcaacgttctaaaagttcctacattcctctttggtttaagtgagaatatcacattcaagtcacaaagaagcggctcattcactaacagggtaaaaagactgtcatcttctaggtgacagcttcacaatttggggaaatgatatgctatgtttttctgtttttcagtctttacagaatttgatcatgttagttttacaatttcaataaatgtctactaaaaataaaatacagtgaatctctgctatggctagaagagacatgtgctaagattccccctctcacgtaaaatgacaaaggaagatcacaaaactggagaaagtgatggagagacaatccacaggtcacctaagtcatagaacatgaactatacaaggactaaatcttttctcttacatcatctattcatttaaattattcaagagacttttgtaaacattaggaaattggtccctaaaatgtcatgtgtatttaagtaggaaaaagaaagagaagggcatcgagctgcatggtaaattactctgatgagaatctagagaaaacacaggataaaccacagttctgagctgcaggcttcatgagactgaatcagtgatggtaaatatggcttctcagccaccatgtgccccgtcctcagtcagctggcaggacttgtacagggcttcccaggcggggctcgtggtaaagaccccgcctgccaatgcaggagacttaagagactcgggttcgattccagggtatggaagatcccctgaaggtgatcatggcaacccactccagtattgttgcctggagaatccctaggacagaggagcctagagagctacagtccatgtggctgcaaagagtcagacacaattggaacgacttagcacacaagcacaggatttgtgtcacgtaatcaattctcagtggacagcttgaccacctatataaaaacatgtatatcctttgatccaataattcctctttccagtctttaagagctgatcagagaggtacacaaaattatttgcatgcagctgctcatttcagccttctctacaatatggaaaaaatggacaagccgtccatgtccaacgaaagggcctacttagataattaagtagtgtctatgagggactcatgctgcctttagaaagaaacatgcagacataaaattggtgatatgaaaaaaaatctccatgacatgttttgggcaaaaagaagaagtttataaaatgacatgcatgatatggtgtcatttatatttaatgacatgtacaaatgatagcgagatatctggaaaaatgatctccagtcaattggcagtggatagctctaggtggagaatttatggcaatgtttactttgctccttattttgtcctgtgttgtctgaaccttctacaagagtggatttggatttcatcatctggtcctggaaggaggtggaaagaacagccgcaggagcctcttggaaagtcctgggaaacctcaggacaccgatcagtgaaggtcctgtggatggattggagggtggtcagaaaggcttaaatgatgtggaagcaaagggagtgcctaggcagtttatggcaagagaaaggactgtgacgaagcagaatttctgggtgattagactgaattcttgcgagtctgagtgcgattgcctgtctccattattattcatagaattcctgccatcacaggactcagtgggccactggaacagcctgctgaccaggatttttttggttagcttaggacctgtgcaggcaaagcaaatactaagttaactgtctcaagaaataccaccatctttcaaagtggaagaggaagaaactgttccagggaacatagtaaatcatcaaggtccacagtaggctcaaaactatcctgaatggcagttgcattcagcactatgagaaataccaagtttttctttcctaaaaaaaaaaatgaaaaaagagattaaaggatatactcttactataacaggaatccagcagtgattatggaatatccttctaagtattaaacgtagctttgaaatcctcattaaccaaagatgtgagtagttatctactcaaagtgtaatagggctaatgggcaaagttttctgggtgggtaaataaggatctgggcttggttactagtttgcctgattgaagattctttttcgagtgggtggagctagcaacagaaactaaatgtattcacttttcaaagaattgtcaatactttattaatatattttccattaactaaaagtttttaaagttatcataaaaatatagccaaaacacttactaaaagggaaatatttccaaaattatgaccctaaagagttccaaattaaataccatcctcattttcagaggactttcctatttgatccttttaaaacttcactgccaaaagaaatcaaagataaaaccgtaaagtaaaaccaagctacaacaaaggcacttcaaacatttgcgcctatttaaacgttttagaacatcttgaagttctcaaacctagttagaaaatatttgatgttgcgagacagattttctatcatgcactttgagttaacacagagataggacttaatacaagaagcatggcttctccccttggggattcttaagacaagaaatagagcatgttggcagtttacttggtttgaattaatagcaatgtatttaaggatattattaagatccagttattctctggccgttcaccgcttaaaattttcccatttagcagaatctatacatggctaatgttaaaaatgaggttttttttgtgagaccaaaaaaaacaaaaaaagtatgcgattgtataatcttcaaagtgtttaatttgtattaaagctaaatcccgaggctctgaaaccttaggggctctcgatgtggatttttgttctggttcacacaccttgagacaaaggctcatagtcaagatgtggaggaaaaagacgtttttttgtgtgcgagatgggggcaaatttattcccgaggcagcctggaatgggcttcagaaaatggatagagtgtcttcttaaagaaagggcctctaagtaaactcgactgccattcaaaagatttgctctgacacttaacaagtggtgcgggaagaaaggaaaatctgttgtcaggtttggggtgtttatcagcccccctcgagacacttgacctaatgctttgccccccctaatccgctgatctgcatgccacggctttgcgagcctcagcccccaactgccggccaaattgcctgcaacgcttgtcccagcatccagccccctgggtacattgtgtgcggctcacctactccgcgcctcccctcccagcccccctctcgcgggtccccttaaatttaattctgctcacaaattgtgaaataagttgtttgggctggatttgtcgagtgaattgtcccactaatgaaacagtctgttcattatacagtcgtaggacggaagatttagcgctcccataccccgggacccgggcaggttaccgtttttagacggacagttgacaaaagaatgaatagctctctcctgtcaaatcaggcttacaaacagcttggcatacaaacagttactacttgtatgcatgcggatttagggtccccacctgctaatgccccagatttgtaagtacaaattggttagtcttcaaactgtttgcaaaaggaagaaaatgaccaaaaattagtttgttttagccttttcccctcccctcccctccctgctcctgcaagtgaaacattaaaaaagagagagagacagacagaagaaaaggataaaatagtatgtaatagtctcgtggaatattgttggctttttttacttaaggcatcgaatgaagctggatcagtgtttggtaggaaatattttgtgctgctcaggcatcctgcttctcagcaagcagctgaaaatctaatagaattaattgaagacctgtgatgttaaaagatggaggggaggagatcaaaaactttcggttctattcattttagtacctgttgtttaagagtagttacaatacctcccttttgatcgcattggtcttttaaaatgggtcatttagatttttgaacctttttcatagggctgctgctgctgctgctaagtcgcttcagtcgtgtccgactctgtgcaaccccatagacggcagcccaccaggctcccaaccctgggattctccaggcaagaacactggagtgggttgccatttccttctccaatgcatgaaagtgaaaagtgaaagggaagtcgctcagtcgtgtccaactcttagcgaccccatggactgcagcctaccaggctcctccatccatgggattttccaggcaagagtactggagtggggtgccattgccctctccagcaattatgtgtaaattagacaaaacccattttatttttctgtgcaggtttcaactttttgaatacatgaaactaatgtattgagggagactgcattacaggtaataaggtgaatattcttaccatatgatttatcatcagtttgtgatcatttttagtctggattgggttaagtataattctttgatttattataaccacaagagaacagcagacaaaattaggaccacatatttctatcactttataggagaaacaaaggtacagactaacagtttttcaaagtcaaggttgaggtaactaacatttctgacttaataactctttccttcttgaccagatacaatcccaggaaggccaattccttataaaaataggagctgggatttcatattttagtaagttcatcatcacatttctacataatctaaaaataatttttaaaaactcagatctttaggcaactttgtaagcagctgctgctgctaagtcgcttcagtcgtgtccgaccctgtgcgaccccgtagacggccgcccaccaggctcccccatccctgggattctccaggcaagaacactggagtgggttgccatttccttctccaatgcatgaaagtgaaaagtcaaagtgaaatcactcagttgtgtccgactcttcatcaccccatggactgcagcctatggaccaggctcctccacccatgggattttccaggcaagagtactggagtggggtgccattgcagttatgagtaaattcaaacatcccttaacacctttacccttcatgcttaaatcctactgttattttgcagcattgagttccaaacagtaagtaactgttaactcacaaatgtgcaaggtcaatgacatttgcctttggaaatgtgaatagagcaaaagcattaggctgctaaagagtaagcggacagccttcgaccctcatgtggttgaatcattttttatgactttgtccaagtatagaatatactgcatacatgagctctgaagtcagcattggtcctttaaatctggggacaagtttcaaacaactctacagcaaactctacaggacactacacaagaccagccctggagggtctctgcatttcctctctctccccactcctcccagaactcggccaacatttccctatatacagcaggcattccttttcccagcaaacctaagattttgtttttaccatttcatcatgacattttagggcattttgaagatataggcaatgagttatgaataacttggggctgagaaaatgcatatagttagtgaaataatatttttagagaaatatgcttagagaaatggcatttctccgtgaattttatcagagaaggcaatggcaccccactccagtactcttgcctggaaaatcccatggatggaggggcctggtgggctgcagtccatggggtcgctaagagtcggacacgactgagtgatttcactttcacttttcactttcatgcattggagaaggaaatggcaacccactccagtgtttttgcctggagaattccagggatgggggagcctggtgggctgccgtctatggggtcgcacagggtcggacacgactgaagcgacttagcagtagcagcagccgtgaattttatagcagaatgactcctttaccgtggaaagctattggaaaattcaagggctccagtaatcagttacctatttggggtaagcttctccttacaatccactaggattaaaaagaacctgggggtgagcaaggtcaaagctgctccaagctccatgcaaagattgaagaaaaatgaatttagggctgccttagtgctgatgagaataagttgctggcagaagttttttctaatagcaagtggtaagtattaaaatacaaagctttcctgttctaaaaaggagacctggtgctaaagaaagctgcataattagttgggggtgggggggtagggcttcaggtttctgcagaaagaggtgccattgacctacatgtacagtctcccagggtggcaaagtgacccctctcagagccaccctgcccctgcaatacgggaagaacagtatttcagactgttcttgtgatgaataagttacacctaacacagtgcctggtcacctggtccagcaattaaaattagacatgtaaaatcaatatctatgtctggatctatccctactctgatgaggtttcagagtaatctcaactggctaaagcagaaaagtcctagtgtccagaggcatccgaaaagcccaatggaaaacacagggtcgtagtttcagcttaataatctcaccgattggtaaaccgctttcgggtgctagactacctggtaaaacttaaatcatcaaatgtcaggtctcgatggatgcctcccttattacacagatgaggaaactcaggttcaaattcagttcagttcagttgctcaggcatgtccagctctttgcaaccccatggactgcggcatgccaggcctccctgtccatcaccaactcccagagcttgatcaaactcatgtccatagagtcagtgatgccatccaaccacctcatcctctgttgtccccttctcctctcaccttcaatctttcccagcatcagggtcttttccaatgagtcagctcttcacatcaggtggccaaagtattgtagtttcagcttcagcatcagtccttccaatgaatattcaggactgatttcctttaggatggactggttgaatctccttgcggtccaagggactctcaagagtcttctccaacatggggttaaaaatcagggcccctaacccccagtctaataatgttgtcttcaacacattcattttacttatttttatttttggctctgctgggtcttcactgctacacgggcttaatctagttgtggtgcccaggcttctcactgaggtggcttctcttgttatggagcacaggctctagggtgcatggactttggtatttgtcgtgcatgagctaagtagctccacagcatgtggaatctaagttcccgaaccagagatcaaacccgtgtcccctgcataggcaggcaaattcttaaccactagaccaccagggagctggacacacaaagagatggacacaactgaagtagcttagcacgcacacacagaccattaggaaagcccccaccacattcattttaaaggaaatactatatggcaccccactccagtattcttgcctggagaatcccagggacaggggaacccggtgggctgccgtctatggggtcgcacagagttagacacgactgaagcaacttagcagcagcagcagcataaatgttataacctggtttatattttaggtgcgtgcatgcgtgctcagtcatgtcccacccttggcgaccccatggactatatagcccgccaggctcctctgtccatgggattttccaggcaagaacactgaagtgggttgccattttcttctgcaagcgatcttcccaacccctggatcgaacccacatcttgcatctcctgcattggcaggcgggttctttaccaactgtgccacctgaaaagccaatgatcttttgggtacataattttatttgtataaaacgggatatttgggtaagttcagtgaattttctaatcgacactggccactttttgccttctaggtgtgtttgtggatctgtaagagctatttttagaattagtgtctgctttttttcctagttaaatcctgaggtggtgattgttgttttgttacttgtaaagtcaaacgaaacttctttttttttaaacatatctattctcttttttcttaatgtcttttaaaatcttgacatcgaaaatgcatttttcacataaaagatttactgatttgaggaaactgtacctaaaccagtgcccaaggggaaaatgaatggcaaacagaaatgcctattacaacaggatttatgacaaatgtacttgctttaccttacataggttcccttaagataacctcgggtcccctagaaaaacctctgagaggtttttgctttctcctttgccatttcccttctgggaaggctgccagaccagcttcatcacaagcaccaattcaacaagaggggccagaagctaaaacagctacccttcaaggctcaggttaggctatcagctgctcatcacttggactaaatcttgccttgactcaacagagtcttaaaattcaagtattatcagcactccagtttggcagagattatcttttagagaaagggatacagaaagaggaagctagagccccaagatgatttcatcatttcgcccttcagctcacagcagatgcaggcagcagccaccaattcactctttagctaaacatggggcctctatagtcaatcccatttaagaagaaatatagtgtaggggttgaaaatcaaaataaaaagcaaacaggctacgtggtcagaggacactgctttgattttgtttcagctactccaaagctgtatgaccttagttatttttttctgcttgtatagactgtttgagttaactttttattgaggtatagttgatttacaatactgtgttaatttcaggtgtacagcgtagtgattccatatttttgcagacagtactccattgcaggttattacaagataatgactaactccctatgctatatggtatatccctgttgcttgtctgtagtatacataatggactgtatctcttcatcccatgtccctaatttgcccctccctcaccctttggtgaccacaagcttgttttctatatgagtgtgcttctgttttgcacatacattcatttgtattattcttcactgtccataggtgagtgatatacagtatttgtctctgactgagcgacttcactttcacttttcactttcatgcattggagaaggcaatggcaacccactccagtgttcttgcctggagaatcccagggacgggggagcctggtgggctgctgtctatggggtcgcacagagtcagacacgactgaagcgactcagcagcagcagcagcaacgctcctttgtgtgtatgtacaccatctcttaatccagtcacctccggacgggcacttggttttcttccgcgtgctggcggttgtaaatagtgctgctgtgaacactggagtgcacgaaccttttcaaattagtgttagattgctggatcatatggtagttctactttcagtctttggaggaacctccatattgttttccattggagaaggcaatggcaccctgctccagtactcttgcctgggaaatcccatggatggaggagcctggtgggctgcagtccgtggggtcacaaagagtcggacatgactgagagacttcactttcacttttcactttcatgcactggagaaggaaacggccacccactccagtgttcttgcctggagaatcccagggttgggagcctggtgggctgccgtctatggggtcgcacagagtcggacacgactgacgtgacttagcaacagccatgttgtaccttggttgagtttcccatggcttctacatctataatgtgggggtggcactggatattctcaagatccccctgtgttctgctcttctaagtgaggtccttggaccggcggcatcagcgtgactttgctaggaaggcagaagctcaggccccgttccacctgctgaatcagaatctgttttggtaagacgctgggattattcaaatacaagttaacatttgagggacgcccacttacaatacacttctctctacactctcaagttgccgcttgaggctttggcaaggaggtgtgtaaatgaagactggagttttgccgctaggatcccccaaacgccagaacactacccagcggtaggggttgccaggctagttatttaatgagttttatgatacattcagtcttccagacctcaaggcaatttgaccattaaagaaataacttttttaaggtagcccaaaacaagccaactcaagcgcatgatgggattagcgtggtgatactgaaatcagagccgcaccacgcgagtccctctccatccgccaccgctgctgtcctcagcgctgattacggcacattgtttcatcaaattaaacaccaaagggatgttgtaaaggcaacatatggccctctttcaaaagtagttagcctggcatcgcgcaagcggcccatcgtggctccccccacccctcgcctccccgaaaccttctaaatcaacgcattgagagtatttgcttttgcaaaacaatgtctcataaaagtagttgcttctaattgcgggcttgctgttgtcggaagcgcgaccggaatgtgagacgtgaaggagaggagacggaatcaggttagcaggaggaaatcaactgtctgtcttttcctgtttgcccatcccggtggcagccgtcatggcagagaagaggtctgttctcagacccgccacgtggaggcacgtggagctctcagagatctattttttggccctctctattaggcatggcagacggggggtaggtttgagaatccaaataggaataattacatgcagttaaaagacgtgctgaaaggcagaagattttctttaatgatcaggagagagaggggacggtgttgtgtggaagagccagcctcggagcagctttgtcagcctctgctgggttcagtggaaccttcaggctttataagaggctgtttataggccactgaaaggtgaggcttttcccttgaatttcaagagaaaagtcatcagcaacatttggagcagtgtttttgattgttattttgcactgatgcagctggtctttcctccaaggaggatgaacactcacctaagtataattagcagaaagcagtcctcacagagggcttccctggtggctcagcaatgaagaatctgcttgctatgcaggagactgcctacaaggcaagcgactcaggttctatccctgggttgggaagaccctcaggagaaagaaatgtcaacccactccagtattcctgcctgggaaatcccatggatagaggagcttggcgggctacactccatggggtccacgacttagcaactaaaccaccacctctcctcatagagcccctgtgagccctgcgtgggatggtgtcaaagccatcttcctctctgcaaattgcaaccctttttctcatcctccactcaaagcacccccaaaataaaagagcttaaccatcttgggtacagcgtttccattcagatagccatggagtatatgtcaagtcattcttcagtatacctttaattagttcagagctgtttgtcaattatatttcaataaaactgaggggagaaaagattaccatgggtcactcctaccttctagtctgtgtgtagccctttgtccctctcaccatacaatggggcttccttggtggctcagtcagtaaagaatctgcctgcaatgcaggagaccctggttctatccctgggttgggaagatcttctggagaaggaaatggcaacacactctagtactcttgcctgggaaatcccatggacagaggagcctagtgggctacagtccacaggggtcacaaaagtcagacaggacttagcaactaaaccaccatcacctccaccataaagttgcccaccacccctaagggcacccctaagtttgtaaccccttttgtgtctattcagagacaaatacagccaagcaggtagggaatctttgactcacagcctgaaaaacaaaactttttttttttttttgaaaaataagaaatgatttttttaaaaacttttggaaatacactgtacaggataaaataaaaagtgaaatcttatcagctgaccatctttctgaccaaccttctccctctgctcaaggctgccactgttactggcatgttctgtattttgaaagggatcttagatggtgcccagtgaagttcccagtagctactggaatctccctgtgagatgagaatgctgtagaatgaggcaaaaatgctgctgtaacttcaccctggtgggaatatctcacaaataacataggctttcatgctggaagttgggagatactgacttttatcttgataacttttttaaactctgggaggatcgtcggggtgctagtttacccttcatgaaacggacatgataaaacccagtacctttctaccatgcggcaataaatagctaggtaaccaggacaatagaatccaggagagtggcaattttagtggtctcaaaattccgagcttttttccttaaccaaatgaaatctttaaaactttaaatagacagaagctgaatgaaccatcattgaggtcattgcctggcaaaagagcgactcataatgcaaaaggatgattttagtgagaaataaaactcatctataggtctgattaaaaacattcagcatggagagagttcgttataaatgtcatggaaacactgtgctctggctggaataacaggggcatatgtgtcttagagtggggtgtggtccctccattatgagcctgagaacacaacacaaatctatgcccccaaccaggatgaggcgggatctagtgaccaggtggctcctggtgtgggattcgtggggcttggtgcacatgcagagcccttttcactcagctgaaatagtagataggcttaaccaatttaaatgatcttaataaactcgtaaccctggcgttagggccactttgggatctactgcagctgaagcgtagcaaccaaccaacctgctggggaaggagctactcaaaacacacctgtgatgagtgattctttggtatcaatttaaagcccaaacactgatgcaatttggccctctttagagccaggctgcctcagccactctctccattaattagcgtgagctgtaagatgttgctaatagctacacatcttgtaaacatgttgagccgatcctgcccctgaaggctggcaccgttaagtgatatctcagctggggctggcagagccagcgtccccattagggacaagcccaaaggtgtgcagcctctgggaagaaatcaaaacatcatgctccgagtgctccctttctgttgtggttcccatagaggtgactgctttttagttgtaatgataataataatgaggagaataaaaataagagagagagcagcaggacacaaaacttgggtgtacattcactagggaacatttctgatgaggcctagtggtggcgttctggaaatactggtttcttgccaccaaggtaagcagacttcaatctggcagaaaagaaaggctctcgggctgaacctcagtcagctgagataactggtcaaccactttagagcttctagctaccaaaactaaaaccatagcagaagacgatgagaaaggttttgtgtttgcctggtggctcagacagtaaagaatctggcctgcattgcaggagaccggggttcaatccctgggtcgagtagatcccctggagaagggaatgacaacccactccagtactcttgtctggagaatttcatggacggaggagcccggcaggctacagtctatggggtcgaaagagctggacatgactgagtgactaacaccatcaatctcaaaccagctttcagctaggaaactgctaagggtgcagaaaggatgagtggagaggtagagaggccccatggctgcagcatggttggtctgctaactttatgctcaaattcttctgtaggattatgttctaagtgtgcagaaagggtgatggtggaaaccaaggagagaggaagcctgagtttggagtcagctcattcctgtttgcctgcagccagtttcagctgtccaatgtccagggaaacctctcagtcccagagagaccaggacagttggccaccctacttggagacacagagggacatgtggagagagacccccaaagaccatgtcatccaacttcctcatcttatacaagcagaagctgagatgcagtggggtccttaagaagcacagcatgggactcaggtcctcttaaaggatgactggacgtgctgttttgtcaggtgggtaaaatcaccagtggttacaaaatgcgaacacgacacaagacagtgaagtgggttctaatcccggttctgccactaagtgggggaccttggataagatgattcccacctgctaagcacactccactgaatgatattcctttgaggaaggtttaatatatccacttacctggtgaaaaattgagttcagaggaatcaagtaactgtcctaatgtcatagtaagaggtgagatctgaaggtgggctcctttgacatcaaaggatgtcacattcccaggatggcacttgactatatgaaactgttggcaaattccaacagcccattgctcccaccaaatgactcatcccagaatgaaagtgaaagtgttatttgctcagtcatgtccaactctttgcaaccccatggatggtaaccaaggccctctgtccatgggattctccaggcaagaatactggagtagattgtccttcccttctccggggaatcttcccaacccagggatcaaacccaggtctccagcattgcaggcgcattctttaacatctgagccaccagggaagcacctagaatgcccaaatggtggaaaattaaaggatatgtaccttccctgtttccaagaaggatttgctatagttcaatccctgggtcaggatttagcttagccagattacatgtattgacctgagctttcttttcttttctcttttcttttacaagagtctaccagcactgatagatttaaaaaaattttaagtcatcagtttcttatctctgccagaatcagaatagaagcttcataaggacaggtattttattcactgttataacccaggacacatatacctggccatggtaggtgtttcatctttcatcttttttgaaagaaagaacttcaaaattaaacatgtataaatgttaaatatttatgctgtatatttttattttataatggatttcaaagttgattacaaaccaataaacaaggaggtagaaataaggaaaacaaagatatatctgccagaaattttttactcaaaaaattattggatgagctcttaagaatatgtgtgtatttttaatttttgtaaattaaatattttaattatcctaaaggatattgctatttaaagaatcacttttttggtgtggttcctgtaatgaaacaaagaaatgaaactttaaagttaagtctcatttccctttatttacatgatgatatatacacagggagcacaaagctatttgaatggggtcgtattttatacttatttttgccttttacatatttaccaagtatctatagtcaaaataataaataatcagaagtctttaagctgatttttaaagtaagtctttaggtcttttctaaatgattaacactttctaaactaaaaacgtcacggtttggtctttaagttgtatctgactcttgcaacccatggactgtagcccgccaggcttctccgtgcatggaattctccaggcaagaatactggagcgggttgccatttcctcctttagggtatcttccagacccagggaccggatccgggtctcctgcagtgcaggcagactctgtaccgactgagctaccagggaggcttaataaacatatgcaagcacctctgtttttccagcacgcatgttatatatatgtgcctgtgtgctcagtcactgtagtcgtgtctgactctttgagacgctatggactatagcccaccaggctcttctgtccatggatcctccaggcaagaaaactggagtgggctacggtgctctcctctggaggatcttcctgacccggggatcagacccaagtctctgtgtttcctgcattgcaggcagattctttaccacagagccaccagagaagccaggtttcctctaatactatggcttcccaagtgtcactagtggtaaagaatccacctaccatcgcaggagatgaaagggacatgtccaccacgaagagctggacatgactgaagcaacctagcatgctatactatggaggaagtggacacgcaatgttagcacttgagatttacgaacaaagctttataccagttaccgagttttatgttccccagctagttagcatttgaaaatgagaaaacatctttgaaaagtgtatttgacagtgctgagtaagaatagatcacataacttcaaaaatgttattgaaacagcctcagccttagaacacattttagaggaaaaaaggtaaatccttttatagagttaatcataataaataataaagctataagccagcttggacagctggagatcagaaaataaacttaaaagctatatgtggtgtttggagtttatgtatagatgtaatgatctgagaaataacttcctgattggattgtacgaactctgtgttagacgcgctattaagatactgacggacatcatctttctttgtggatacaagaagtctagcacaataaagaactgattaaacctgtgaccatttcgaggcaaacactgcataaaatacccgtactacatcaaggaaatgtgttaacagatgcatgaagccatatgaactctgcttctggcttagtctttgtatctccctagaactatgactaatcctctttatctgaaaacttcaaagactctgacttgacacacatggcatccatgtaacaggcaaacttagttcctgccagcaggtaatcagaagcaacacaaaggtgtctctgggtgagaattgtcttgttgtccaaggcatcacttcagttgacccaacagaaactcatcctgtcacagcccactgctcagaggcagaatgaagcctggtttgctgaggcaaaagtagcacagcctatcagactctgaagtgatcgatttcatccctctgtatttacttgtaggaaacttattcaattttgcatacctaactttgtaaccaggcaccctagttacttatcttgtttctaacagcttttcaactgatttgtatgaactttagaaatatataataatatggtttgcaaataattccttccccatatgcataggggtttttgtttgtttctcttgtcttctcttttcttattgcaacactcttgcctggaaagtcccatggatggaggagcctggtgggctgcagtccattgggtctcgaagagttggacatgactgagcaacttcactttcacttttcactctcatgcattggagaaggaaatggcaacccactccagtgttcttgcctgaagaatcctagggacagaggagcctggtaggctgccgtctgtggagtctcacagagttggactggactgaagcgacttagcagtagcagcagtacttccagaaaacattaaataatagtttccatagtggtcaatattgtcttatcactgacaatgggaaaatgttttttttcccactatgtgaagcatctattcctaattaaaatttttaaataaaaatggctgttaaattttgatataaagctcttttggccaccaaggtcataattataggggttttgccctttgatctattaatatagtgaatttgatatcatatttcatgatttcaaactatccttgaattcttataatttttgcattttaataaactgacctttatatgctaagatcttcttttagaattgacttaaggatatacaataaaaagatatattgatgttcctattctctttgacactgtaggaaaggggatgctgttaatacagctctagaatttttttgctgaaagcaaagaataataataatgtagttcacacttatatagcatatagtctgtgacagatgctaatctaacagctttacatgtatgaataccctgatgctgggaaagattgaaggcaggagaagaagggagtgacagaatgagatggttatgtgacatcactgactcaatggacacgagtttgagcgtgacatgacttagcaactgaacagcaacaacaatgccttcagtcctcagagcagctctgtaaagaaggtactgccgccatcattgtcatcatctttgtttttcggatgaggaaactgagcttaagttacttgttcaatgtcacacaggtagcaagtgacaaagtccagacaatttgtcatgagaaattatgctttgattcactaagtcactcatttattcaactgtaacatgtacttgggctgcccaggtaggtcagtggtagagaatccacttgccaatacaggagacttgggttcaatccctaggtcagaaagatcccctggagcaggaaatggcaacccactccaggattcttgcctgggaaatcctgtggacagaagagtctggagggctacagtccatggggtcgcagaaatcagacacgacttagtgactaaacaacagcaacatatacttactgagtgcctcctattttgaaggcactacataatacactttcctttaaaaaaagaaaagcaaataaatagttaagcccaagtaatgaatctaatgtttatatccctttagtctaggcagtattttcgtaaatctttctcccttaacttttaatatttaatttattaaatatttatttaacatctgtctgtcttactgagacccagacagaaagaatactaagcttagccagagatcctaggttagtgtgatggcatcctgatggatcctatgtgggtgcccgtagttaccagggaaaactaagtaccaaatgtcttcaaaaatcagcttgctaaggagactacagatgacactgccaggcacaaaacgtattgtctaaaaaaggtagaaaactagctagactaagatgcgtcacgtgacacagcgttcctggtcaagaaaggggtacgaaagtggggagaaagttgttcctcatatccatcagcccaagaaaatcaccaagtaccaccacaggcagaaggtgagactggagccatggtcaggaggtggctttcacaccgtgtgtctttcccctgccccagagtccctgtggcattttaaaaatgctggtccttgataccttctattcagttccgttcagttcagttgctcagtcatgtccaactctttgcgaccccatggactgcagcacaccaggcctccctgtccatcaccaactcccagagcttgctcaaactcatgtccattgagtcgatgatgccatcgaaccatctcatcctctgtcatccccttctcctcccaccttcaatcttttccagcatcagggtcttttcaaatgagtcagttcttcacatcaggtggccaaaatgttggagtttcagcttcagcatcattctttccaatgaatattcatgactgatttcctttaggattaactggttggatctccttttagtacacagaactctcaagagtcttctccaacaccacagttcaaaagcatcaattcttctgtgctcagctttctttatagtcaagctgtcacatggatatatatataaagggatatacccagttgatgctagtggtaaagaaccggcctgcttatgcaggagaaataagagacaaggtttgattcctggatcaggaaggcatggcaacccactcaagtattcttgcctggagaatcccatggacagaggagcttggagggctgcagtctatagggtcacaaagagtcagatatgactgaagccatgcatgcacacaaagggatataaaactataggcgaggtatggggagggaggagggaggagggttcaggatggggaacacgtgtatacctgtggcggattcattttgatatttggcaaaactaatacaattatgtaaagtttaaaaataaaataaaattagaaaaaaagaaaaaaaaaaaacaactataggcgaggtggctccagccctggcctacctttttccagcagtgtgatctctataccttaatgactctgaacgtgagtttcttcatctatgacttgaggataacagtattctatctcccagcgccactgaaaaatcaaaggagatgatgtgtatgaaagttgtttctatgttgcagagcccatacaagtggtagttattattagcttgtttccaaatgttgaatcttgacaataaagactacagcaaacatttttatacacataatgttcaacttcttttgaattccttgcctaagagggattccaagaagtctgattactggatcaaaaaatatgaacagttttattcacgttgttagatcttagatctgaatggctgcctgattttcaaatgctttgaaccaatttccattgtaactggctgcatgtggaagtagcgttttgccaaggcctcatggacacagccggagaaggcaatggcaccccactccaggactcttgcttggaaaatcccaaggacggaggagcctggtaggccgcagtccttggggtctctaagagttggacacgactgagtgacttcactttcacttttcgctttcatgcattggagaaggaaatggcaacccactccagtgttcttgcctggagaatcccagggacgagggagcctggtgggctgtcatctatggggtcgcacagagtcggacatgactgaagcgacttagcagcagcagcagcagcatggacacagcaaatttttattttaaaacacattggctaattgtacaagtggtcatttccattttggactactggtgaaatctgaacatttttcatgtcttcctttatgaaagataattcctcgtgtgtgtgactacttatctatttatacatgaccaaatttcccctggttttgagagagagacgacagcaggtagagaaaccaacctgagctttaaaatatcacttatgtataggcatatttgcaggattctgtggtcagtgaactctcaagaaccaaggacccaagctaaaggttttcttgaaatgcagccctccacgatggcttctccacatccgacgcctgacgctgactctttggcccttttctgtagtgtgttacagaatctgacggtgttgcctctgtgaatcccagggatcaggagatggggagaccgtgtagcctggagtgggctttcaggaaagtcttgagagagaaggcaaaattgccctgccgcggatcagtgagagcagaacttggacatgaggagctggtccatggaaagcacttggtgcctggccccggggctcggctgtgctgtccacggggaccttccgctccatccaggacacgcgtgtgcacagggtcagaacttggaagtaaacggcagaccacaaaacacagaggtaactataagagagctcaaatgatagtattgtaattataatatgtgtgtgaatataatggcatgatatttgagtaaggtgttataacacttgagtattactgtattagaataatgtttgtgtatggctctataatatgtgaatattgatcctatagtatattctttgaatatgtattaagtatgtattaaccttataacatgtgagtattagtgcacgtgtgcatactaagtcgcttcagtcatgtttgactctgtgactctttgggccatagcccgccaggctcctccatccatgggattctccaggcaagaatattggagtgggtagccatgccctcttccaggggatcctgactcaggcctgactcaaacccaggtctcttacctctcctgcgttggcagattctttaccactagccccatccagaaagcccaactgaaccctatggactcattttacagatgaaaacattgaggttcagagaagtcatgtgaattgcctaaggtcacaggagccaagttaaacccacttgaagcctggaagtgtacatcgaatggtatttgtattgtgtctcctgagtgtgtggcaagcttctgtttacttacattatctcatgcaattcttccaacctctccagatgagcagtggctcgtaggatggcactgaggctcagggagataaaattgcccaggctgttgatggcagagcaggatgagctaaagccggtctgcctccaaaggctgttctcgtcccatgacacagccagtctccccaggagatgatggatccacattgcagctgtggcggagagtcagaaagctgctggacccatctgaggcaggggtgctgtgactctgcagaaaagctgagtgggctgggagccacagagacccacagcatttacctagagctcaaccaagcagcggtttggttctgaaatgtgtgctcccatcttcacggcacaccaatgaaaaagagaccaaaaccccaggacttatcacgtcatttggggcaggccataaacatgaaccatacccataaaaattctttgctattagaggtaattggtaaaaacacattgtttgcttgctcaaggtagcaaatctctttcttttcctaaaccttaagacacacacaaacaatgcactataattatcagtttgtcgataaacaggtttattaatgcaagtctctctttggtttttgccttgtaccttgtgaaatcctaatgaagaaaagtaaccattaaccaagtaaagttttcaagtaagaatgaaaatgcttttctcactttatttaaataaagaaagtttatctttcaggtaaacaattttcaaaaagtgaaaatgtttctctcaccttatttaaatagagaaaatttattcttcaggtttagggttctgcttttttaaatgtatggtttatcacagacttaaagaaggaatttataattattgggggggggggatgggggagtgttgggggaagggataggtagggagtttgggatgaagtgtacacactgctctatttaaaatggataaccagcaaggacctactgtgtagcacggggaactctgctcactattctgcaacaacctaaaagaaaagagtagatacatgtatatgcaaaactgaatcactttgctctacacctgaaactatcacactgttttcaatcaactctaccccaatataaaataaaaaaaattttaatgagataaaataaaatatttgctttattaagaaggattttgtgttcttcttacacagtttcttattaatttgcgttccttctttttcaggaaatatagcaacattgtatgcacctgtgctcagtggctcagccataccccgctcttttcaaccccatggactgtagctcgtcagggtcttctgtcatgagatttttcagacaagaatactggagtgggttgccatttcctcctcaaggggatcttcctaacctcaataaagtttgaggggcaggattttcaattttcaacatgtgataatggcccccaacctatttctggctaagaaagagtcagtgggaaaataactggatcgaacacatgtctcctgcattgtaggcggattctttacctgctgagccatcattatgattgtattaatcatttgaattaaatataatatactttgttattgactttcatttcatgccttagcatccagtacaaatatcaggccatgtttgagtgatgatcattgcaaatgattctaggtaaacatttaatatttttaaaactcagaatcttttcataaagtttcttttttaaaaaattacaattaaactgatagtcctcccatattgaaacagatgctaataaaatgtaatttctagtggctaaaggaaatcaaagtcatagtaaattaccatcatattatagcaaattaatttgaaatctatttacattgtgttttcattttatttacagtttgatggctttaaaattttgtgctattgctgtacacctgaaattaacacaatatggtaaatcaactatacgtcaataaaaattattttttaaaattataccatttctccatgtctattattacttgaatcttatgcaaaaaaaaaaaaaatatatatatatatatatatatatatatatatatacacacatatatatactgatcttccctgtagctcgaatggtaaagaatctgcttgcaatgcaggagacacgggttcaatccctgggtcgggaagatcccgtagggaaggcaatggcaacccgccccagtagtcttgcctatagagtcccacaaacagaggaaactggcaggccaccatccgtggtgtcacaaagggtccgacatgaggaagtgactataccataaccacgtgcaaaaaaatgtgtctgttcaaaccagagatgattttgaaatcgactgaaacacaaatttgttgcattaatagaccaagttacaaaatgcaacctgaccttgaactgtggatgattagtgtatgttgaatgtggtaaagaacaattgacagaattaagtttgccctgggaaaacatgttatggcacaatgttgcaacagatttcctgcattttcaactgtaagagggagagagtttgcatgaataggatagggctgtggtctctagagctgcaaaatgcgggtctttgtaaccttcatttagcgcccttgcaaatcctttgaatataagcatggaaatattttaaatttttgaaacaactgatttctggagtttcaaaatattttcccatatttcaacagccgtaaaattacaaagagaataataataatattctgcgaagatgtgtggttttgtatgaacacattaaaaaaaaatttacagttgtatttaactggctgggctcagtttacggtgggagtgtttggctgacggctatagttcctaaggaaaaatggatgtgagtgcttatatgtgattgtttgctacctgtaatcacattgacagcgttagcaccataaggctggtgacaaaaataaaatactagagagctacacaactctcctgggggaaatcagagcccgagaaagggcagtctccccataccaggccccagctctgccaggctcattaggacaccgaggtctggagcctagcaccatctgccaaggggcacttggctttgcccacctttcctacttcagcttcagagctgggaacagaagcgcaagtgtcggtgagtgccccatttatcttgaatgcacgtagcctcctcttttctcattctttgtgccccttcttgtctcagctgttggttaaagatctgataaccacattgacaccctcctgtcaatttaggtagtcgggttgcttcttcgatttaaatctgagaatttaaattctcaggtgacttcctgagaatgtcacctgagacattccctggtgatccagagattaagactccgagctcccaatgcggggggctctggtccgatccctggtcagggaactagatcccgcgtgccacaactgaagatccccatgctccagtgaagatcctgcctgctgcaactaagacccggcacggccaaatacgtaaataaaaataaatacctatattaaatctgaaaccttacctctgagatgtatggagagcattagaagttatagttctctcacaaaagcaggagaacactgatgggccacaggcccaggtgaccaggcctgctaagtcccaggtctcaaagctgcaggggccttcacctttcagccttgaggcagcaaggtcgcaggcctcgtggctgtctgtcagttcagtgaggacacagcactagggcggctccaggcctggtgcggtcagcgcctccctgtactgagctaaacaaagccgcttggcgtggctccatgacgtttaggactgcggccccggaggaggaggtgaaacagcaggtgacggcacacaggccgtcttcacacaggcctggcccccgtgggcgaaaggaagagcatgcattaaatgcttttcagctccttctgagctctccaattctgagactcataacagctagggcaaagactgctttttaaataaatttttattggactatagtcaatttgcaacgttgtgcccatctctgctatatagcaaagtgattcagttacacacatatagacattcttcttaaattcttttctattgtggcttatcacaggattttgaatgtagctccctgtgctatacaggaggactttgttgtttatccattctaaatgtaatagtctccatcttgctgttgttcagttgctctgttgtgtccgactctttgcaaccccatgtactgcagtattccaggcttccctgtccttcaccatctcccggagtttgctcaaactgacgtgcattgagttggtgataccatccaactgctggcattagcagtttagctcattgctgtttagctctgtcgtccccttctcctcctgccttcaatgtttcctagcatcagagtcttttccaatgagtcggctctttgcatcatgtggccaaagtgttagagctaaaaaatagaagattatgagagcacaatggattaatttataccccagtgatagacaccaggaatgcagcagagaagaagcaaaccaatgccatcaatgagcttacctactaacaggggttggaaaggccccaggggccactggtgaccacacgtctattctcacaccttcccaacccagctcatgaacgtcgattttgaagttagaaatcggtcacataaactattgctgttgttgagtcgttcagttgcctccagttctttgcaaccccatggactgtagtctgctcctctgtccatggaatttcccaggcaagaatactagagagggttgccatttccttctagagaggatcttcccaacccaaggatcaaagccaagtctcttgcattggcagacagatttatcactaagtcaccaggaagccccaaataaaccatacgtctttcaaatataactcttttgcagtaatttagaaaaagactgaggtagccctttgtgtacttaagaaatggacttaagaaatgctaagaatccaggacatagtaaagcagttattgttgttcagtcgctcagttgtgtctgactctttgtgacctcatggacagcagtgcaccaggcctccctgtccttcaccatctcccagggtttgttcaaactcatgtgcatcgagtcagtgaggccatccaaccatctgatcctctgtcatccccttctgccctcaatctttcccagcatcagggtcctttctaatgagtcagctcttctcatcaggtggccaaagtattggagcttcagcttcagcctcagtccttctaatgaatattcagcaatgattttctttagaatggactggtttgatctccttgcagtccaagggactgtcaaaagacttctccaacaccacagttcaaaagcatcagttcttcggcactcagctttctttatggtccaactctcacatccatacatgaccactggaaaaactatagccttgactagatggacctttgtaaagcaattatcctccaattataaaagaaaagaaaatccatggacacaacagctagcgtgtttccattatgcagtgtggacatccacacaaagaggcatacgggcacagatgaatctgcgtattagaatagctctggagagttatacaagaaataggaagcacggatggactctgaagagaggaactgaaaagcccagggtaagaagaggagaaaactttttttttctggttggagtatatctgacttacaatgttgtgttcgtttcagatgtacagcaaaatgattcagttaaatgtatatatttattcttttccattatagattgagatactggatagttccctggatatagttcagtaggacctttgtgtttatctattttgtacttgtatctgctaatcccaaaccactaattcatcccttcccgcccttcccctttggtaacccatgggcagaggacgctggtgggcgacagtccatggggttgcaaaagagtcagacatgacctaggaacgatatataccttgtcttctttatccattcctctgttgatggacatttggcttccatgtcctggctattgtaaatagtgctgccatgaacactggaggctgtgtatctttttgaattatggttttctccggatacatgcccacgagtgggactggcggatcatatggtaactttattttaggctttttaaggaaccttcatactgttttccataatttacattcccaccaagactgtaggaggagtccttactttcattgcgtttcctttttcactgcttgcatttttatctcacatgttactttttcagtgaaaaaaactaataagaagtaaatacccacacttggaaggaataagctcagtttaacatttgctctcatactgtattcaaaccaaagtcagcacaagtttaggtactcagtagtgtccgactctgtgcaaccacatggactgtagccaccaggatcctctgtccatgggattttttcaaggcaagaatactggagtgggttgccatttgctcctccaggggatctttcctgacccagggaccaagcccatatttcctgcattgcaataagattctttactgctgaaccattgaggaagcccaggtggattaaaattgttaatttttaaagaattaactgtatgctgcaatcatcaatgaaataattgactcaggtgagaattatcaatgggttaaaaaagccagtgggccagagtttgttgggggaacaagagagtcacgtagactcaaagcttcatcccacagattactttttaattgtggaagaaaatttaacttcatctgtgggtaaggaacgatgttttccagcataaaatcaaaagaagaaatccaccccctgaaatacacgctaattaaacaggtctgattgcacacaaattgaaattttctttccctcaagaaaatttcactgtaagcctgattaaaaagtaaactgcaaatttggaaaaatgaatatggaagtgagctagtctatgtattacatgggctttccaggtggtgctatggtttaaaaaaaccaaaaccctgcctgccaatgcaggagatgtaagagacctgagttcaatccctgggtcgggaagatcccctggaggaggaaatggcaacccactccagtattcttgcctggagaatcccatggacagaggagactggagagctacagtccctagggttgtaaagagtcagacacgactgaagtgacttagcatgcaggcaagtattatatacaaaactgacataaattggcttttaaaaagtaaaaccacaataagaaaatggacaaaggaaaaacatatttcacagaatggatgataatatgaaaaaaagtcttaccccatcatccaccaaagtaatgctaagtaagacaaaactacttttcaaattagccaaaattcaaaatatgagattacttaaagtaacaggcactgaagctggaggaaatataaatcagttgaaatgttctaaaaagaatttagccagtgtacatcaagaattaaaaaacagttcatatacatcaactcaataattctacttctgtgacactaatctagataaataagccaaatgcaagcaaggcttcatatctagaatattcatcacatcattgtttatagtagcaaacagttggaaggccctcaaacatagggaaatagttaatcacaatacttctgaaacttccacacaatagactattttgcagccaataaaatcagggttcttttggtgaaatagtcagacagcagcaaacaaaaccatacatcaggatccctatctggatttttttaagaaaactattaaagaagaattagattaacaatgaccatctctgtgttgtgagactatgcatgatttttatgttcttatttatactcctttgagtttgctaaacattttatcatgattttgtaataggagaaaactgtatgtaataacggtcatagcagcatcaaagctaatatttactgggcatttcctttttggtatttatttacttggttgctccatgtcttcgcggcagcccgtggaaactttggtcctcctgtggcgtgtgggatctagctccctgaccagaggttgaacccaggccccctgcactgggagctcggagtcttagccactggaccaccagggagtccttactgcgagtctcttacgtgccagacacattgcctgcactatctcatttacagataattctgtgttggaaggactcgtattactcccactttgcagatgaaaagaccaagttcaacgttagttccagaaaccacatcaggcagtctctccccaaagtccacgtgtttgaagaatttaagctgatgaagggaaatgagcgtgataattaataattatgacaattttttgtaattaacagagaaaaatattgacatcaaaatattaacagtggccatgtctgtggatggaatttagatgattacaatattttaattttttatatttttaaaaataatcataaagtgaagtgaaagtcgctcagtcatgtccagttctttgtgaccccatggactatacagtctatggaattcttcaggccagaatattgcagtgggtagccactctcttctccaggggatcttcccaacccagggatcgatcccaggtctcctgcatggcagacagattcttaaccagctaagccacaaggggagcccaaaaataatcatagattactttaataataaaggaaaatgacaaaaaaatatataatgtagtaatattatgggttaatttggaaaactcggttcagttcagttgctcagtcgtgtccgactctttgcgaccccatggactgcagcacacacgcttccctgtccatcaccatctcccagagtttactcaaactcatgtccattgagtccgtgatgccatccaaacatcgcatcctctgccgccccctattccgtttgccttcaatctttcccagcatcagggtcttttcaaatgagtcagttcttcacatcaggtggccaaagtattggagtttcagcttcagcatcaatccttccaatgaatattcaggactgatttccttttggatggactggctggatttccttgcagtccaagggactctcgagagtcaactaagagccatgtaataagacaccttaagtagaaaatacattttaagttcccaaaacgtgaaaacacagccctctacagagaggtggctggttgcaccacatcaaatcatttttgatgattcagtatgcttatacagcataggtggttcaatgataaaattctcacctcccagtcaacgtacccctgggtttccctggtggctcaaacagtaaagaatctgcctgtaatgcaggagacccgggtaatagtatttcctcagggcctgttgagtacttttttgtatctaccaaagtgccagcacaatttttaaaataagaattatcttcataaatgtttattgatggaaagtggcagtactaagagaaatgttctggggattttttttttttaattaggaggcacaaggacatacagtaagcatcttgtaaggtgaattgattcctatctgagtcctattaaaacctaaagctgcactgtctattattcaggttctttccaagacaaccagaggaagaaagcctgtgaatatagaatatcagaaagaaggcgagcaagattcattctcaaatccaaagttaggtccaaagatacttcctcagaaaggcatttgctttctgctgccttcactgaagtgtttgctataactaactataccccatcttctctttcacccactctcttccctcccctaattctaactcagccacaagtctcaggggaccatcagtatcgttccttccgcattaaatggaagatgcttttgaactgtggtgttggagaagactcttgagagtcccttggactgcaaggagatccaaccagtccatcctaaaggagatcagtcatgggtgttcattggaaggactgatgttaaagctgaaactccaatactttggccacctgattcgaagagctgactcatttgaaaagaccctgatgctgggaaagattgaaggcaggaggagaaggggacggcagaggatgagatggttggatggcatcacggactcagtggacatgggtttgggtgaactccaggagttggtgatggacatggaggcctggagtgctgcagtccatggagttgcaaagactcagacacgactgagtgactgaactgaactgaaccgaaccacttctaatttggcttcttcagtcaggaaagctgctaagagagcttaggcacctcctggggaagtcagccagcttgtcagagagcctgtctatccggtttggtttgcagagaaagactgccatctagcgccagaaaaagcaatgttccattcattttcttgagctcacaggggataaaatattgatagcaccatttcacttttacgctgaatcacatttaaattttttcaggaaaacatttgatcgtctttctaccctaaaacgtgtacttcagtgaattgaaaaaaacacataattgggcacttctttcctatgcaaatcaccagaagcctaagctagacaggaaaagggatgagaagagaataaagcaacttcagttcatgaccagtgtgctgtcttcctcttcattgctggtgcttttccctgtgtgtgtccatattatgactcctttgtcaaaagcttcacctaatccagtcccctggactcagattacatatatgttcatatagcaacacttcctgatgccgttaagatctttcaaaatagagacaaaccagaattcactgtcagtccagtgcttaggactccacgcttccactacagggggcctgggttccatccctggggacggaactaaggtcccacatgtgacatggctgggccaaaaaaaaaaaaagagagagagagacaaacttgttttggtctgtgcacaggttggaaaagaatttccagacacaaggcagaatgagagaatagtttattagagcaggagacgctgctagaacaggcagccaactcaaggcagagccgatgcctttgtgggctagtggtcaatttttatagcctcaagacagtaaaaatccctgctggaagagtggcatcagctgattggttagtatgctatagggtgggtaatttttacctaatatgaggtcagagagctagctggtttaggtcagggggctcatggcaatggttgctagggactcagtctattccagagatgacattgggacagggctccatggcctgtggacaaggctttacacctgtgaccttggtatgcgtgcatgcgaggcacttcagtcatgtccaactctttgtgaccccatggactggcccgccaggctcccctgtccatgggattctccaagtaagaatactggagtgggttgccatgccctcgtccaggggatcttcccaacccaggaatcaaacccacacgtcaaacatgcatctcttacatttacctgcattgacaagtgggttcttcacaattagtgccaccagggaagcccttggtatagggctccacaaaactgatgatctaaaactcagagtaaaagcttaaaatttatgtcatccaagttggggatgatgagcattatcaggtgtgccctgtagacctcagcaaagcaaactctagaatacgtatagtaaaaatagacgatatgattgggataaaaataaagaaatccataatggagaaaaatgataacaacaaatttaaatataccaataataatattaatggttcaaatcatcacacacagtttaggttaaaattttagctatattctattaacaaaagataaatccaaaatgtataaacacgagaatagtgatgatgaataaaggaatgagggataaagatatgctagaccaaaaaaaatctaacttcagattagggaagagctccctgatggctcagtcgataaagaattcatctgcttgcttcctgggtcgggaagatcccctggaggagggcatggcaacccactccaggattcttgcctggagaatggacagaggagcctggcgggctacagcccgtggggtcataagagtcagacacgactgagtgatctgctaccactggggccagccccctcacttccagtctcagctttaggagcactctcagtgagagcctgggcaagttcctctctgttctttagtttccacatctgaaaaataaggatactagtagcctccaccatatatatatatgttgagaggattccatgagtaatgcttacaagcgttgaaaactgcttgacacttatgaagtgctatatacatttttgttcttactgttcattgttgttgtagaagtagctacacgtagttacaagggacaatgcgtgctcagattgacctaacaaagttcagcaattttagtaactaagggaaaatgtgtgtgtgtgtgcgcgcgcacttacttgatagtcaatagtgaagggtagcaaagaagaagaaaaagcaataaaaaaatggaggaggacaacttaagagttcgtgatccactcctgtcaaaagccagcacaagcatatataaatgagttgaactactctactgaccattttatgtcatcattttgtctgtgtgtaccccagcaactgaccctcaaacagcccccaccaagaataagctccagggggtatattttttacttctctctgtctacttatacattccaaaatgtgaggtgcatcagaaagaccaagtgaatgtgagcaccccctttaacatgcagtttgttaaggtaagcgatgtgtgtgcgctcagtcatgtccaactctttgcaaccccatggactgtagcccaccaggcccttctggccatgggatttcccaggcaagaacactgaagtgggttgccactgcctcctccaggggatttccccaacccaagtttcgaacccacatctcctgcattgcaggtggattctttaccattgagccaccagaaaagcccagtaattttactacacgctcataaaatgtagaaaaactgccgtgtacagaataatgcctcacctgcccaaacaaatgtcattatgtagatataatgctttgtggttttgccacgataagcatgtgttttttcagcagtaattttactactataccatgcatttttattagaagattatagtcatcctaattttgtcagccagttgaacacatttgtactatttctcgcttttgcaagtggtatttaaaatactgaaaaattgatttttagaaaaattctgtgaaccataaccctaaattgcatttctaactgaccaaatagcagcaatgatttgccacctaaatccagagacttcaatgagtttataaaaaaaacattatttggggcaagtcacatagataatagttctatgatctgaaatatccagggtttgctatttcctccccagtacactttaagggtttatgatagacacccagatcaccatctgagggctacaggttaggagaaacatgagaattagcacagagttggatactgcagtaggcctttcgatccatcgtcttgagtagctggcatcctttcccctcccatcaacgcaagaggctggggacttccctggtgatcccgtgcttaggactccacttttccgctgtagcaggcacaggtttgatctctgattgggaagctaagatccctcaagtcgtgtggtgtgacagaaaaagacaagaaactcatttttctgtcccgtttcatatcagtgtctggtttctaacaaaattaatctcttattgcttaataacatctgtaccgtgtgctaaatcacttcagtcgtgtctgactctttgcgaccccaaggactgtagcccgccaggctcctctgtccgtgggattctccaggcaagaatactggagtgggttgccatgcactcctcccagggatcttcctgacccaaggatctaacccacatctcttatgtctcctgctttgacatgcgggttctttactcctagcgccacctgggaggccaatagcatctctaacagacattaactttttgcccatagtttgaaacttctagaagacatgaggtcaaatgagtgtgagtatatcctgtaaaacagagttcgttaaggtgttgctgataaactgcagggtttaaggtctgattccgccagagtccagtgtcaccactaggtggcgtacttggtcggaaatccataggttgcggggctgtatggagaaggtttacagactgagctacaaacgttggaagcagaaacagaggtgatgctcgtggtcccaacggttcaaaaaacagcaggaagtgggtagttaatgactgaggcaccagactagctgaatatgtgggctgtaagtgaagatggcaccgctaagctggtatagccctccactttgagtgcacaagcactctctcttgggttgctgttcagtcgctcagccgtgcccgactctttgcgacgccatggactgcagcacaccagccttccctacccttcaccatcttctggagctcgttcaaactcatgtctattgagtccctgatgccatccaaccatctcatcctctgccatccccttctcctcccgccttcaatctttcccggcatcaggatcttttcaaataagtcagttctttgcatcaggtggccaaagtatttgagtttcagcttcagcatcagtccttccaatgaatattcaggactgatctcctttaggatggactggttggatctccttgcaatccaagggattctcaagaatcttcatcaacaccacggttcaaaagcatcaattcttcagtgcttggcttttttatagtccaactctcatttccatacatgacttctggaaaaactatagctttgactagacggatctttgttggcaaagtattgtctctgcttttgaatacactgcctaggtttgtcatagtttttcttctaagaaaaaggagcccagtctctggttcatctagctgttcatggattccagccacttgcctttcagcaggcagccagcaaatccccagcataattgaaggcacaggcctagtgtggattcaggaagtaggcccagcaagttccctcatctgagacatctgaacctccccattacatcacactggtcagtgtaaacacctgggccagttggtcttctaggtttcctaagagtcccctccctcatagacatagatttcactccctgggctcctgtacattaataaacagactaatgctgtctagccctttctccttttttaccctgccccttattagctgtaccctactccaggcaatcaaatgcccaccaggttcatacttcagtcttctgaggctgtagtaacataaccagtccccccaaaatggaatttctggtgcctcaaaattagactagatcctgaaccctgatgaccatctaaatgcccagccatccacttctgtggcatctctaaagcatcattatattcacagcataaagacaccataaagggtgtccttccattatcatattccaattttgaatctgcttccagtaagaggtgattctggcttgaacgaatgagtctctgttattggtcccaacaaagatggaaccattgtgcacggaggctgctgactgttaatgaatggaatgctgttccctggttatattgccttgaagaaagggaaattccaaactaagccaaatcatgagtataaccagaatttaaaatattacaatataagcaggtcttaagagaatggatgttgacaaaataattcttgtggacaattcattgaaagacagttccaagtctttttaaaatttgttcagtagttcaagaaaaattttatgcaagtatgatgggaaagactataaccttactgtagctgctagacaaggtcaagatatatcaagagcatgttcccttgctgttacagtttgaataaacatcagtgcagttgcttgggggcttcccaggtggcacagtggtacagaatccacctccaaatgcaggggacacaggacactcaggttcaatctctccgtagggaagattccctggaggaggaaatggtaaactatattaatggtaatatatatactggttactggaaatggtaaccagtattaatggtaatactccagtattcttacctgggaaaactcatggacagaggagcttggcaggctacagtccatagggtcacaaagagtcagacacgacttagtgactacacagcagcagcagctccttagagacccatgtagacacaattactcatagggttctgtgtgggagaaaagcatcctggtttaggcaatgggtattgtaaagcggtgaaattaacacagcaggtcagtgccccacaatagcaaacaaattggagaagcaaaggatttctgctttggaaagctaaggaatattgaattgatttgccaggagtacaaagagtattaggagtgtagcatctttgtgccaaggataaagctttatgattcctagtgaaggaagggggccccacaagaaagaccggcagagtattaacagcctggatcagcagaacagcaacatctgaattcttctttccaaatcatgtgcttaactgtaaaatactctcctttcttattcttagaggactcactggtttctctccataagcagaaagcacctcttagaatgtcctttgtggaagtgttatttcttttctaattagtttgagttgggaccatttttccttatagcacagtattagcatctagtgggttcactcagaaatgaagaggttgatcttgggagatctccattgggttcctagtagagggtgatttctggggagggtgtttaatgaggtggagacttcatggagaaatgtgaagactgaattgaggtaagctattgtgaaatctggctacagaacattttaatgactttcactgcaattaatgaatgaaaaaaaagaaatccaatcaaaaaaattcagttttgacttcatttgatctctctgcccttttgaacaccatataatacccctatctcatttaagaaaggactgaggggcttctctggagactcagcggtaaagaattcacccgccagtgcaggagacacggctttgatccctgatctgggcagaccccacaggctgcggagcaactatttaataggcccgtgcaccgcaagtattgagccaacacccaggagcccgggagccgtgactattgagctcacatgccccaattactgaagccctcgcactctagaacctgtgctctgcaacgagagaagccaccgcaatgagaagcgcgtgcactgcactgagaagtggcccctgctcactgcagtcagagaaaagcacactcagcagtgaagatacagcacagccaaaaataaatcaacagaattttttttttaaactttacaatattgattggttctgccatatatagaaatgaatccgccacaggcatacacgtgttccccatcctgaaccctcctccttcctccctccccacagaatttttttaaaaagaaaggacttaggataagattacatgttttggagggtagtaagttgatattagtattttctgactttttcaatggctttttcaagcagttttattgagatatggttcatatattatacaatctgccctctgttcccttgtgtccaactccttgagatttcatgaactatagcccgccagcctcctctgtccatggaattttccaggaaagaatactggagtgtgttgccatttcctactccagcagatcttcccgacccagggatcaaacttatgtatcctatggctcctgcactggcaggtggaaatacactaatttaaagggcaaagtttgatggttttagtattaatatattcacagaattgtgattccatcaccattgtcaactttagaaacttttcatcacctcataaagaaacccacatccgttagcaatcactcgctacttaaccccaagcctctgctcagtcagtaaaaaatcttgcctgcaatgcaggagacctgggttcgattcctggcttgggaagattccctggagaaggaaatggcagcccactccagtactcttgcctgaagaatcccatggacagaggaacctggcaggctacagtccatggggtcacaagtattgggcatgacttagagactaaaccaccaccccctaggcgtaggcaatgacaaatccttctgtctccaaagatttgtttactctagacattttatataaatagaattatagtgtatatagttctttcagactagcttatttcacttaggtaatgtttttaaggtttatccatgttgcagcatgtatcagtacttcattccttttttattgccaaataatattccagtataaacataccacattttatttatcagttaatatttgttagttgatgtgtaaagaaaatgtagattgtcttcagttttagggtattatgcataatgctatgacgaatctttgtgtataggattttgtgtgaatgtatgttttcattttcttggatatatacctaacactgagattgttgggtcatatggcaactctgtatttaatccttcagggaattttcagaccgttttccaacgtggctgcaccatcaatgacctcacatctgaaaagtttctcagtgtcccagagagttaatcaaacttcaattacttctattcctatttttctatgattttacatttcactttcactaatctcgtatgagcttcattcaacacatttgaaattttcctccagattccttgccagtgattccagaaacgttgctgagtaatctttaatatcctcattgatatgtattcccatcttttatatatcatatttttgtatttaataagcaatcattctgacttgtttatcctcttatgcggttcatgaggttctcacggcaagggcactggggtgctttgccattccctcccccagtggatcgtgttttgccagaactctccactggaacccatgctaggggcttcccaggtggtactagtgataaagaatctgcctgccagtggaggagacacaagagatccaggttcaatccctgggtcagcaagatcccctggagaaagaaatggctacccgctccagtattcttgcctggaaaattccatataactaaggcttctgctgctaagtcacttcagtcgtgtccgactctgtacgaccccagagacagcagcccaccaggctcccctgtccctgggattctccaggcaagaacactggactgggttgccatttccttctaggcttcagcattatatgaaccaagaaattccagatgtcccagctaggtttagaaaaaagcagaggaaccatagatgaaattgctaacatttgcaggatcatagagaaaactagggaattctagacaaacatctacctctgtcttattgactatgccaaagcctttgactgtgtggatcataataaactgtggaaagctcttaaagaggttggaacatcagaccattttacctgtctcctgagaaacctgtatccagatcaagaagcaacagttagaaccctgtacggaacaactgatggattcaagatcgagaaaggagtacgacagggctgtctgctggcaccctgtttgatttgtatgctgagcacatcatgagaaatgccgggctggatgacataagctgaaatcaagataggcggggaaacatcaacaacctcagataggaggatgataccattctaaaggcagaaagtgaagaggaactaaagggcttcttcatgagtgtgaaggaggagagtgaaagagccagattaaaattaaatattaaaaaaaaaactaagattgtgacatccagcccccattacttcatggaaaatagaggggggaagagtggaagtagtgactgatttcctcttgttgggctctgaaatcactgcgggtggagactgcagccatgaaatcagaagatgtttgcttcttggcaggaaagctatgacagacctaggcagtgtgttgaaaagcagagacattactctgccgacaaaggtctgtctagtcaaggctgtggtcttcccagcggtcacgtacggttgagagttggaccttcaagaaggctgatcgccgaagaactgatgtcttcaaactgtggtgctgggaagactcttgagagtcccttggatagcaaggagatccaaccatcaatattaagagaaatcaaaggactcatgctgaagctgaaactccagtattttggtcatctgatgcgaacagctgactcattggaaaagtccctgatgccggggagatggaaaagagggcaggaggagaagacggcacacgcgtttctcaggagacaggcaaggtggcattctctgctcttcaagagaagggcttccaatgtctttaggaactttccgcagtttgttgtgatccacacagtcaaacgctttagtgtagtcaatgaagcagaagtagatgtttttctggaaagcctttgttttctctatgacccagcagatgttggcaatttgatctctggctcctctgccttttctaaacccagcttgtacatctggaagttcttagttcaaatactgctgaagcctagcttgaaggattttgagcataaccttaaagactgtaaactttgttttaatggttcatataactaatctctccttatcattcttcatttttgaaatattctttattatctcagttaacttcagaaaacttgtatttgaaaaaaagcccagtggtgttttatcacaattgcattagctctgtaagttaactgaaattaccatttttacaatacttaattcttctaccttgaaacatggaatttctgctgcagaaacttcaaaacaagacttgagtaatcagtaactgtttcttccatgaattaaaggagaaggaagaatcaaaagtgtttctgagattctgggtctggtgactgctgctgctgctgctgctaagtctcttcagtcgtgtccgtctctgtgcgaccccatagatagcagcccaccaggctcccctgtccctgggattccccaggcaagaacactggagtgggttgccatttccttctccaaagcgtgaaagtgaagtctttcagtcatgtctgactcttagcgaccccatggactgcagcctaccaggctcctcccgtccatgggattttccaggcaagagtactggagtgggttgccatttccttctccaatgcgtgaaagtgaaaagtgaaagtgaagttgctcagtcgtgtccgaccctcagcgaccccatggactgcagcccaccaggctcctccgtccatgggattttccaggcaggagtactggagtggggtgccattgctttggtctggtgactaaaaggagcttaatataagctgacagagtattgctaagggctatcaaaaagaagggggaatttttttcaatgttattttggaggacagaaaaacagtcaatgtctcaaaattatgaggagatagattcagccattcatactaaactattttacatagtagagctctcagaaatgaaaaacaaaacaaaacaaaacaaaactgctgtgtaaggaggtaaacccttcatttctggaggcattcaagtgagggtggattatcaagatgacagccctcctatttctaatagtctatgctgatgatttgttctccaaatgaccttagtataattgaaacaagggcctgggattcatgaagaagaaatgtaaaagaagatcaaggatggactttgggttgtactcaaaggaaggagaaagagaagttgaaagaagagaaagatataattcaaatgatgaacaaaaccccagagaaaaatcacagacccatgacaatcatggaggcccaaagacaggttggttagtggacaggtgcagcagggagggtaagtaagagtgaagcttagaaagagtcactagatgcgaaaacaaagtcccagcaggacctggagagtgaaagtccaggacatgtatttgacggtggagtcatggttgagtgacaccaggagtgagtgagtcgggtgaaggtttattcatttcaagttgaagacattgtgcactttcatatttcagagtccagacagtagggatttagagatagaaagtatagtcgatcctggcatctgtagttttggtagtcgtggttcctaccatttgtcaacgaccccatgagggaaggcagggagtgatttttcagtgtcgccagggcacgcactggaatcacatctgctgtgaaacttctgggcaggcttgagtctcttatttggagagcaagcctggccagctgtccgacatctgtatcacatcgtggctttgttattctctactaatctctgaacagtgtgactgtcatcaagtggtaggaactctccttcttcgtagctccaggcacgcttcatggataatgttgctattaagctgacgtacgatgacaaattactttagtccagtggaccctagaacaatggggtttagaggcaccaacgctccttgaagtagaaaatcttaatataatttaaggggacccttggtatctgcagttcctccacatctgtaattccacattcatagattccgtcaaccatggatcatgtagggctatattatttactaatgtaaaaaaaaatccatgtgtaagtggacccatgctgttcaaaccatgttgtttaagggtcaactgtactttgcgaaaccaaagtgtctaaaaacatcactgtaaggttttggatattctttccattttttgaaggtaatcataagtgagtgatacaacagtgttatttttgaagctctcagggcgcatttcttaaaattattaagattctgattattggaagaggggagacatcattatagaagaaagttctctcaagaaatgagacggctggtttttagcctaaagaaacaagaatttgagcttagagaaagaagaatttggaaagaagaataaaggatgtgtctccgactgatttccccagagagcagacatcaggaaaatagtgtctccatgtactttactggagactataatctgaagaaggaggggtaaaggcatgaagcagtgagaagctgcacacggtgccttattgggttgcttgaccccatggacctcttgagaatctgtataatgtgcatcttgggatggccagcctagggtgagaagggaagaagcatttattcatcagctggcagccgccactaatcaaaaaacactccaggaggccggaacaccccagcactctggggtgtacttgtgaggattctgaggggtgcctgcagggtcccaagccatagtgaaaagagataagttctaggatgggaggcaggaggggctgacagattgtctccgtgtgctaccggctggacccctgggagaactggtcaccacagtggtggctggaacaaaaggcaagtggaggctggaagaaaagtctgaagtggtgcatgggaggtgcctgatccaagatgttcatggtgtaagaagatgtgtgccggtatgagcagaatgataagaaaagccaggtcctggctcctctcaaggaaaaaagacaccaggtgctcttataggaatgaggatgctgtgtaaggaatgagtgttctatataagcagagaggacctgtcaaaattactgggaagagcagactaaaagaatggtggggtagtaggttcctctgatgccaagcattatggacttgtaattctttgcattttctcaagagtgccatcaccctaaaagcaggatctgctggtaatccaggggtgggctggtatggggcgtcctgcagagtttaggtgggagagtcatcagagtggtggggaaggcagcacagaagcagctgatcagagaacgaagggttgatatgataaagtaaaaccaaggtaccccacgtagaggggtgtctgtgagggtatgagcagagcgggagcaagggaggaaagaataaaggggaagcatcttgggacttccctggtggtccagaggttaagactgcactctcagggctgagggccctgattcaattcctggtctgggaactatgatcccacaagccgtgtgacagcaccaaggaaaggaagcatcttgaaggtggaacagagccctgtactgatgacaaagtctaaaggacactcagtgctacgaggtgaggacataagggtctgtgtcctgcaggaaattgagtaatatggttgctgacgttgccatagacggagttgagaaggaaaggaggagactgacatggttcctgaagttgcctgggacagaataaacgggattagatgatactgataatgatttggaagtggttaagacggtggatactgaagctggagctccaatcctttggctgcctgatgtgaaccgtcgactcgttggaaaagacctgatgctggggaagattgaaggcagaagaaaagagcaacagaggatgagatggttggatggcatcacagagtcaatagacgtgaacttgggcgaactctgagagatggtaagggacagggaggcctggcgtgctgcagtccgtggggtcgcagaaagtcggacacgactgggcgactgaacaacggcagcaagacagtggccctagagacttcagatgagagcgcacagagaaagcctgttggagacagtgggtttgagatttcatcataagagtttaaggagccagcgtattaatgagcaatcaaggcagttgctgaagtttgaaagcaaagcaagatttgtttcactgcagacttaacatgagctctgtttcttcaggatgtgctggagagatctgtggagatttccacttttacttaacacactgggtattatttgaatgtgccagcagaagcctgcacagctcttgtgatgaaaaagaatgaaagggacaaaattagtcaaggccaaaaatagaattcaagcccacagaaaacaaacacttgtccaccacccttgactccacagctgaacagaacaggcaggggaatggtttcattatgcttcccaacattcatcttcgtgaaaccaacttaaaccatgtgaccccattaacacaaagagcaaagggaaggatttcagagagatggagagagatacaacctagtgtaaatgtttaacatgccacatacagagatccagccacatgttattggcagttgggtttttttttttgcccttcaggtttccagggaggagtataccccaccccgtctgtgccttcatcccacttgacaagaggtcccggaaggcatccatgtcctgcacagagaaggtgccaacaagtaatgatcataatagcaccacgactgaatgcctcctttgtgcatggtttaggcccaatactctatgtagtttatcctagttagtcattaaaataactgtgagtgggtgatattaactctgatttgaagactgggaggtacagggctgctgagggattcagcagtgtccttgggacacgaggctccttcatgcgtctgctctgccctctatagtgataggatttacacacacacacacacacacacacacaccctgccccccagtctgtgtctgtgctcaagcaggaagaagcagcagaagaggcaggaacagcaaacttccattcattttgtattgcccagaactagtgtaccattccagggatcatgtcgatcacagacaacacttcagctggtttaaacagcaaggagttccttaagttatacagaaagtcttaaaccactggggagggctggaaagactttagccggactcaggaagccaccacagagctgggccatcgagggagctgctgcctcttccgtaaccagacagcggctgaattaagaggcctcctcctccgacaggaagccagtgccagtcacgagttcaaggcatccacgacaaccaggaagcaagtcgatcagaaaacactccccccagcactcgctcccagactgggccagttgtgccgagacccaggccagcaccagagatgctcagaactcttctcttgctccccgctgaattcaaattccaaacaagtgctcgtggtcctctctccatgtgactcagttctgaatcaagaaaaaataatcaataaaaccaaattcatgcatggagttccagctgctatggtagttgaggactctgcaagttgagtgttttggttttctaatctctgtagctgaggcaagcaagagagaaaagtgtaagaacggaggctgactgtgacaggccattgtattgtaagcagttacagaaaaactcaaatggactttttggccaacccaatattagccacaattgttctgaaagttgggaaagctggtatagggatagtcgtccttcccttattccattcgaggcatccttgccacatatatcatctcatttaatcctatctctagctttcactttataggcaaggaagctgaggctcataaagtttaaataacaatgttcaatatctttcataacctataatggaatataatctgcaaacaataactaaatcactgttatacacctgaaactaactcagtgttgcaaatcagtgtactgcaataactaaaaacatttaaagtaataatgttccagttcagttcagttcagtcgctcagtcgtgtccgactctttgcaaccccgtgaataatcgcagcacgccaggcctccctgtccatcaccaactcccggagttcactcagactcacgtccatcgagtcagtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaacacccagggctgatctccttcagaatggactggttggatctccttgcagtccaagggactctcaagagtcttctccaacaccacagttccagaaggtagcagaatcgagattttgaactaaagttcacattccactctcctcatgtggtagaattcacatgcctgctttattgaaactaaacgccaaccataatggattctcgttattcttaattcctttgttctgattatgaatccctggctttcaaagagctgtagaggccagttgctctctggcccccaaaccttgcttcagcaattttcttctttggttttgttatgtttttttaacaggtaagaagtggatttacttagagagaaacacacgccacagagtgtgggccatctcaggagagagtagcctcaaaagatagcattgctacttaatttcattgaggactgttccagctatttcaaagaaggggcggggatttcccggaactgggtcacagcccactttttggtcttccgatacttggcctcagaaccgtcatggcatccagcagttctcttaattctttgagtatcttgatcctgtggaccacctgagaagctcgatggcatgtgtatccggactgtatgaggtgagaaaggaggaaacattatccatcggaatccgagaattgtcccatgggacactgtcctttccagaacattgttctactcatatccagccaccctttcagccccacatcaagcacttctccacagacacttctccagtcttcccgtcaaaatgtggtcttattttttccaactctcccacatattttctttgtgcccactcctcaaacatttcccacaatcaacatatataactacccttttcgtattgcaacttctttgaagacaagaatgaagacattcatctctattgttcttttaagcttctggcacagtgcaggagtgtggaaagagctcactggataaatgataaagaaatgaataaacttccctagggaggtgctctctctttagcgtattgactaatctgtatctgggggatgataaattcaattgctcttgttgtctaatgtttttaagtagcaaaacttttcttcatcaccaccatccatctggttcctcccataatgagccctcatcagttaatgtaacagaatattttacatgtttatttgtttttaacattttttaaataaacttaagacagagcttgctccttggaagaaaagttatgaccaacctagacagcttattaaaaagcagagacgttactttgccaacaaaggtctgtgtagtcaaagctatggtttttccagtagtcatgtatagatgtgagaatagtcatgtatagatgtgaaagctgagcgccgaatcaaaaagctggatgcttttgaactgtggagttggagaagactcttgagagtccctcggaccgcaaggagatccaaccagtccatcctaaaggaaatcagtcctgaatgttcactggaaggactgatgctgaagctgaagctccaatactttggccctctgatgcaaagagctgactcattagcaaagaccctgatgctgggaaagattgaaggtgggagaagaaggggacgacaaagggtaagatggctggatggcatcactgactcaatggacatgagtttgagtaagctccaggagttggtgatggacagggaggctggcgtgctacagtccatggggtcgcaaagagtcggacatgactgaacgaccgaactgaagagagagcaggactgtatctttgttttgttttttttctgctgaagtttggttgatttacaatgttgtgttagtttctggtgtgtagcaaagtgatatacacagatatgtgtgtatatattctttctcatattcttttccattataggttattgtaagatatagagtatagctccctgtgttacagagcaggaccttgttgttcatctgttttacatacaatagcttatacctgctagttacaaacttctaatgtattcctccccctcccctttcccttgtagtaaccataagtttttacgatgctattttggggagggggcatgcagcacggagtgtggaatcttagctcccccaccagggatcgaacccacagccccgttcatgggacgctcagagtcctaaccactggaccgccagggaagtccctggtaaccataagtttgttttctatgtgtgtgagtctgtttctgttttgtaaataagttcatttgtatcatattttagcgctagctttggcagcacatatactaaaattgcatcatattttagattccacagataagtgatatcatatgatctttgtctttctctgtctgacttacttcacacagtgtaataatctctcggcaggactatgtctttggagctaaaatgagttcattttctctttggaacaactacactgggacaatttttatactagttcgggtgtttgccataagtaacaattcactgggccaaaaagagtggaacaaagcatgagcatgatagtaaaagcatcgaggggtcttccacgctccatgtttaatccattcaatttcctgctaaagtggaattcctcgcatcaccgtcagcccttcaggtcagcgtagagcagcagtctcctttgactcttctggaagctttccactttggaactcccaaagagtggccagcagtgaccaagacgggttctcttctgctgtgtggttcatgaaactggagggctggcagcgtgcttctggttgccatggaaatgaccagggccactggccttctgaaaacggaaaagaacagcaagtgcaagaacaggcattccgtccttcctgccggcagatcacaccagctgtcaagcctgagtgaaggatcagcccgggagtgcaggagacaacctcttagtggagctctgagatgtaagtcatttctctgttcttttttgaaaagcctatctagcttaacagttttttacagcttcagatttctgctgcatggcaggaaagttctgtaatgtttgaagagccaccatcagcaccaccttcttctgcagtgtttgtgtttcatgagtataacgcacacttatgagtcactttcaccgtgaaactctcctttaagcttccgggcatgtgaatcgctttgtactgagattctctttcctttcaaaggaaatgttttcagaacatcaagcaaagaatgaaatggtcttctcattattccctaaatagatagactcacttaggttaatattatgtaacagatatctccgtggaatctgggcttcttgtttctatttttaagatctggcaaaaattaaaaaaaaaaaaaaaagaacaacaaaaaaatccagctatatttcctgttggtcattaacactaaataagaactcagtgaaagaagtatgtgttatatctcttttccttattgcgatcacaagcaaaactgggaactctcaaaacattggtttttatcgtttctttgtttttatctaataatgttatatttatataatggtgttatatttactgtttatttacacactcttcattagaaaacataggaagacaagaagaaatcaaatttaaatgagcatcaacatttagactggttaactttttaaaaaaattggtccctgtattcaaaagtgaaacaaacacgataaatactatagcaaaagcaacaggcttatagggatgtcttagtcaaaaccagtaatccttacacagttctacgtatattccattgtttcataaatatgttttgggggagtttcttagcaatacgtgtcttggtgcatattgaggaaaggaaatgtttcaaaagaactgggcataatactcataaaaacttgttcttaaaaactgccagaaatatcagactttttttgcttgaaaatttttttgatgaaaagagtgatctttgggaagtttttttacttttatttttataccaaataattcaatgtaatgcattattttaaaatgtttgaaagggataaaagacttcacatcatatttttgacagaaattgggcattttctgaaaagaacaggtccgacaaagcatctatggacatgaatacttctcaacagctggtttggatctctcaattttctttttcacctcggtattttaattacttaaacctagtatactatctacctttaaaattcagggtccgccgaatttcctggtggttcagtggcactctcactgccaggggcctggcttcaacccctggttggggaactaagatcccacaagccacgtggtgtggacggaaaaaacaaatcaggcgcagtggatcatgtctctgtgtccgtggtcagaagagacaatcactcactttcccatggctgtgtgatcaggggccagatgcactgagctggagcaccagtgatcagattagcgaagtgtataccaagtcatttgggcttcccaggcgtcactattggtaaagaacccacctgtcaatgcaggagatgtaagagacatgggttcgatccctgggtcagggaagatctcctggagaaggacacggccacccactccagtattcttgcctggagaatcccatggacagaggaccctggcgggccatggtccatagcatcacagagagtcagacacgacagaagcaacttaccacacatacaagcataccaagccatttacaggaaaggcttgaagggtttgcaaccattgattaattaactctcacaagaacctgtgtcaattagaaagctgcatattttagttaagactgcctattggctcactctccagaagtctttgtcccatgttccctgaccatgtcaaaagaagtagcattcaaccaatgttgtccttaaagatctaatttacaagtgtcttcttaaaaaaaagtgttctgatgcttgtgcaaaatggaactctcttctctccttttgtttcccattcatttagcttgaggttttatacacacttggggttaaaggccacagaatctagtaatggaatccaaggtacaggaggtcatgtgagtaggaactcaaccctaggatgggaaatacgactgtcatttccatcatgactccctagagtatatgtggctgtctgggttcaaatcttagctgtttccttacagctctgtgactgtgatcatgctatgtctgtgtttctgatagtgaaattagggtcataatatctacttttaagattattgcaaggattaaatgatataagacatgcaataatacttcaaacagtacctggcaccaaaagaagcactcattaaatattattattaatactaaggaaacgtgtatttcctaattttagtcatttttcaacacacatgtaactcccacatttcttatttgaaagtacattgcctcttatcaatgaccattttctatatttagctagtttaaccctgggaatacagggctgaggggcagtaaaggtttgtgtgtgtgcatgtcagtcactcagtcgtgtccaactccttgtgaccgcatggactgtagcccaccaggctcctctgtccatgggattctccaagcaagatactggggtgggttgccatttccttctccaggggatcttcccaacccagggatcaaacctgcatctcctgtgtcccctgcactggcaggcagattctttaccactgcaccacccaggaagcccaaagttttgtgtagtaaaacgttaatgcaataacatctcttcctcatctagcagtctgaactttcttaggagtcaagtagtgtacatttgacgaattaaatttgaggtgtctgttatatattcaggtagagctatcaagtaagatgctggatacatgagcgtgaagttcaagggaggatttgggagctggattatgatcagcatatagataatactgaaatgcaggggtcagcatgcaatatccaagggagtggatatacatggggaagagagccagttgctgagcaagaggtatgcaacaacatcatggaaggagagaagatgctagccagatactgagaaggagtgaccactgaggtggctagaaaacaggggcatgcaatggaaaggaagaacagaagggtctttgctcaggaaggagggagtgggcaaccatatcaaatgatagtgagtggtcaggcaaaacgagacaaggaaattaaccattggcttttgacacattggggaatgggagttgttgggaacctgatgacaatcgttccagtggggtcaccctaaggacagcctgattagagtggcttaaaaatctgacataaacaagcactgactttctatgtgactatagatttgcttatacaagcttggtttttcctttatggttaactgaggtagacctataagaggttggaggcaggcaagaactgtcatccgtgaatctagtctaccaaagattcgtgaaagatgtgaagacagtttaagagatgagggtggtttcgtgtgtgtgtgtgtgtgtgtgtgtgtgtgcacacacctgaactcagttgtgtccaactttttgccacctcgtgtactgtagcccgtcaggctcttctgtccatgggatttcccagacaagaatcctggagtgggcagccatttccttctccaggggatctttccaacccagggacagaacccgtatctcctgcatctcctacattggcaggcagatactttaccactggaccacctgggaatcctgatgatttcttagcagatgagaaatagaaaacacttctgacacggggcaacataagcagtatgaggtagtgtcacacacacacacacatacgcacacacgtcaggacttgttctaacagttttccccgatgcctcttctttccagttgtgacctatttcccattaaaggaccacttctcatttgcatctctgaaatgcctggtctccctggtcagtaaggaagccaggatcttctccaaggccaggagctctataggagtccttggagtgatgcctagtcaccacttcatggatgttctatttgacccaaattgtgtagccaagtttatccactggagccctgttcttgtcacaaaaataatcttctgtgagtcatcaatgagatcagaaggcattcttttcacataaaagtctcattttagaattgttttagacgtacagggaaattgtgatgctagcacagagagttcccatgtacccaacaaacagtctccccttttattagcatcttacattgctatagtatacatttgtcaccattgatgaaccaatactgatgcattattattattaactaatatccatattttattcagatattttttagatacccaatgtcctttttcttttccaggatctcacattacctttagttgtagacatgtaaaacctcttaaaaatcttccaagaaagcaacaaatttcaaattgccttttgttccaatatttgtaactaaaaccactaaaggaaaaatttaacccttaacttttctgaaatctaatcattgaacgcagatgaaaggaaaaagcttaaggcttacattttaaggaaatagtttaagatactttatggggctgtaataatgtacaactgttaactggaagacctgaatccctttttattgttctggaagcaggtaattaaaatattaaaggtctaccagaattttttgtttctcatctcctagcaaagggattactctgacttattttccttggcaacctcccgctcatataatacagacccagtaatttgagcaaagctcttcccgtgttagttttataagactgtatgcttaaatgttagattgttgggaagtttgcagcagggttcttataagccttcaacaaaagcaattcagacaatagtttctgatgcccacaaatatctatgcgatcaatatgtactcaacgctgattctactcatgtttccctttagtctgtggagtgaggtggaaggatagcaaactggggccctgatttggggctcatggtccccatcttgcgtgactgtgtttcgtcctgtgtctccatcagattcacagaaatggtccaaggcaactgcaaacttagaggatgctcactagtaaagtcacaagaggttggggttgcctgttgggacttatgccagatgtcattcgatggccttcaaggagattcagaggctattgagctcaaatacacccactctttgactaagacacaaaagttcatcatgcttcctctgtcatggctggggcatgcactgaaattcatgctgaaatggattttgcttgctgatttgatcatatgctacactccacaattctaggaggcaaaagtaaaagaggaagcaaaggaggaatacatgcactctgacttagctaacgtagggatgcacttgaataatacaagtgtttatggagggcctccacgtgtcaggcaccagggactgggaaaccaaggtcaaccagaagaccagggctttgtcacatcagagatctgacttacacaacataccaacagcaatgcgtccagcctccaatgggcaaactgtgggtgatatcaacattcagttaagctcagtgctttcaaaacataaaatgcctgttttcacttagctcttaattatctcagactagaagcttttgagaacattggttcatttctatcattaaacacatttatctgaaagcagcaatccaagtgatgcttgaagagatcctggcttcaccaaccagtgggcacatataaggctaaattaacactaactgcttataattgactggtttgtgtccccaccttcctgatacaggtccttgcctccttccataccacatgtctacacaataaagtctcctctaatcatttcttggggtccccaggattgcctcacctgctctcccaaatggccctttcatgtgcctctggcaccgctggatgttaactgtcccgtgctgctgctaagggacttcctgtcgattcacttcccggagagcagagttcaggagcgtcccagtgtgtcctccaggcggggccgaatgatgctgcctgcccctcacccctcactgtgccagacctgggctgccctcagtgccgaagtggggagaatgcctctgtcccccacctctaagccccacatctcagagcttttgagagctgtctaggcaaaatctgcctacagctcctctggactgaggccacagcttcaactagtctgggttaagaagactgagtgctgaagaattgatgctttcaaactgcggtgctggagaagacttgaaagtcccttggactgaaagaagatcgaaccagtctatcctaaaggaaatcaaccttgaatatacattggaaggactgatactgaagctgaagctccaatactttggccacccgatgcgaagagctgacttattcaaaacgatcttgatgctggaaaatattaaaggcaaaaggagaagagggcagtagaagatgagatggttagatagtatcactgactcaatggacataaatttgagcaaattcagggagacagtgaaggacagaggagcctggcgtgctgcagtccatggggtctcaaagagtcagacacagcttggccactgaacagcagcacaaggaaaaaggggagacgagtgctgacccttccctccaccggcccctcctccagacccccacacatcgtcattattctgagcccgttctccattcagattttcaacacaagcagtgtgttaaatgaaccattactttagaggtttgcagaggtggcttttggaatgctctaatatcccaaatatatatattcctattattactattaatataattctgacattacaaaagtcatagtttatgaatagtactaaagtactctgtgtattaatattacagttcttatgagtagttgtaaaagtgaatagcattaatagatatatattaatattacaacgtgcatcttgctttatgcttattttaaccttgtgtggttaaaccctgtgtggtttcatccccatgctattttaagagaaattattaagaaaagactctttggatccaaaatatccagtgagtttaataatcatgaaaatactttaaattgcatctcccgaagacctgaatgcttggtgttgattctgcctgaattccaacttggggagacaaacttgtactttctctggatgaggaaagccatcagatgacagcaaatagttgaggtcctactgtataattctaaggagaaaccagtcccctcagagtcacagtgagcccagtttcctggccctcatgatgagctatgtaaacctctgtggaagggaagtgattttcgtcaacagagactgcacaaggtggtgacttcagaattacctgggagggcgtgtgaaaactgagcggctcgtcccacggacaaggcagaaagatagaaaaggcaacacttatcccagtaagaaaatattgggaagaaacccagattaccttcaacatcgtaagcgttgaggtattaaacactaagcacgtcattcctctttccgatatcatcttacgtagtgtttacgtagtgtttatctctaacctgcttcctgcagtgcacttatggaccagagccaaagaaaaggaaaatgctgaaaatccttattttttttttcaaagagtccttctcaaggttcttcacctaaagccttcatccagcacctctgtgagaatctcatccatataacacagagtagccaatatttcccctctggcctccatgggcagagtgatatcacagccacgaacaagtgggaagtgggcctgagatcagatggccactggattctagacaagagtctcaccccacacttctcccatgcttctatttatcccttgctctccctctaacaaggagcaaggtaggtataaggcttaaagagcgatccccttgggcaagaatgtgtttacttaaatctatgttaaggcttacctggagtgctgcagtccatggggttgcaaagagtcggacacagcttagggaccaaacaacaacaaaaatgattttcgacccttatctgagagtcggtttttagcaccgggcacccaagtttgagtaaactccgggagttggtggtggatagggaggcctggcgtactgcagtccatgggatcgcaaagagttggatacgactgagcgactgaactgaacctggaaagagtggatggagaggaattaagatgaaggtacagcaggggacagcagggcaggagcctcgacctcctccccacctcctcaatcccaccctcttggttctccctactccctcaaggactccagatattgaaataaatttatctggaaagcctggagttagaaggagtcagcaaatggagagagagaaaccattaaagaaaatgcaggtgaaatgtgtttttttacttagaactctttgtcgtctggtctctgctctcataattcagtctccacctggcacctccatgaacacagatctacccaggtcgcccctgattacaaaccctcagctcctcacttttgttgcttgcagggacctccaaagagggtgtgtatatacacaagccagtgaagtgaaagtgttaatcactcaatcatatccgactctttgtgaccccgtggactgtagcccactaggtttctccatctgtggaattctccaggcaagaatcctggagtgggtagtaatgatgttctccaggggatctttctgactcagggatcaaactcaggtctcctgcattgcaggcagtttctttactggctgggccaccagggaagccattttcattattcatctcaaacatttaaaagtccattctttttgtatattgtttacaatgtaaataatgtaagtgtggtatttctaaaacctttataaattaaaaactatatctgttgggaagggttcttattaaaggagtgaagatcagaagagtttggagaccagaccccttagcttgggtggaacagtcccagcctctttcctagcctcatgacccaaagacacaccaagtactctagactgagattttgctgaaattgcttttctgtcttcagcatctcagctttctttatcccagcctctgtcttctcagtccagacagcaccttctttgggagtctttcacattcctgcacaacgctcgagctgtgtctttaattagcacccaccagtcacctcactttacagttagcttcccagccatttgctcccacagtacacgcagtgttccttgggtgacccattaggccactgtggtaagtgaggccgtcttgccactgtctgtgtcagcaagcagtgggcacccttttgatacactccagagtgtgggtacatgtctccctttatgggacacacccaagattccaaattgtctccttttctggaatttttctgattctcaccacctccaaatattagaggatttttgcagggacaccctccagggatggcatttgggggagacatccttgcctaactcctcaagtcctgcatccaagtgttttttttttggacatccagacactggatttcttctgcctttctaccccgtgttgccatttagatttatatttcagactatctgcttcttactggagcatctcatcagtgtctggttctcttacttctctagtttcttaaattgagtcttttccttaaattgcctttccgctttaaaaaaaaaatcactcctaatttcaaattaaatttacttctgaattaaaatttgagatcagtcttcagttttaattgctgcaaggatttggagaacgttactctatattcccacagtcatttttcttgtcttttgtgttaagactatagaattcaaaacatcgttattcgtgacatttcaaatctgttttcaggaaaatggtccaaatgctatcctcccactgacacactatctccttactagtaatatcttcttataaacaaaactagtccagtttgaaacgttccttttggagccaagtataaacattatctaaattttgggtgtaatcctagattgggaaggaatctgtgtggaatttgttttgaagttactgatgtctgtatctgctcaattcaggagtctttgcttttgtgctgttcacattaattgcactcaggatttctccaactgcaatataaaaatgatatttgcactaagcctgaataggagctctggtttctggacatgttcagtgactccatgatcaaagagttaatgatcatacatggttttcagcctcttgcctgaaaggtttaggaggactgacaccatctgagcttttgccatggttgcataaagtcattctttgtgtcttacagcctaggtgtggtcagtaacttttagtgcccaccaatacccatgctctcctcttccttcctggcacactgcagggcatcatttccaagctgcttgcagtcaggtggctcagttctggcccatgaaatgtgggcagaaaatgctgtggaggacctgcaggccctagaagttagcattaaaaaaaaataaagcctgagtccctgaatgactgtatggagccgagtaaatcctccttatgcctttaatggcattagactggaatgtaaggaagcaattaacctttatcctggtttcactatgcatttgttcatttgtgggcagattctagcatggcatagaaagatgggcacagatagatcccatgccccctgcccctccctatgttcctgcccctagggttgtggaaggggttcatatcaggacacagcaggcaaatctcagtgatggagtgagcacaggaaaggctgggacactgagaaaacgatgtgtcagagcaagtcagaggattctagccccacaggaccccccacagcccttgcctactgctgctctggtttcctactgccatgtagtcaaaactatggttttcccccgtggtcatatatggatgtgagggtggaccataaagaaagctgaacaccaaagaattgatgcttttgaactgtggtgttggagatgactcttgagagtcccttggactgcaaggagatccaaccagtccatcctaaaggaaatcagtcctgagtgttcattagaaggactgatgctgaaactccaatactttggccacctgatgcaaagaactgactcattggagagaccctgatgctgggaaagactgaaggcaggaggagaaggggatgacagaggatgagatggttggatggcatcactgactagatggacatgggtttgagcaagctctgggagatggtgaaggacagggaagcctggtatgctgcagtccatggggtcacaaagagttggacatgactgactgactgaactgaattgaactgactgctactcctgccatcttcataaactgtccatctctttatcctactttttgattgtaaaaattctgatcaccctctgctaattacatagataattttccttttatctttcccattcaaaaaatatttctctaatcagatattacctcccctgtgaacttagccactcccagggagtcctactgctactgctaagtcacttcagtcgtgtccgactctgtgtgaccccatagacggcagcccaccaggctcccccgtccctgggattctccaggcaagaacactggagtgggttgccatttccttccccaatgcatgaaagtgaaaagtgaaagtgaagtcgctcagtcatgtctgactcttagcgaccccatggactgcagcccaccaggctcctccatccatgggaaagagtactggagtggggtcctagtgcagactgaatatcccatacaaactgtggttatgattattatcacatgacactgtgactattggttcagtgtgtccttgactagagtgtaactccttgacagagctcctaatggctttctttcctccacttctagcacagtccaggcacaaagcaagtgcgcaacaaatgtttactgagtgaatgaaaaaagcatagtgtatcaaacgtcagtgcaccaagactccttcagctgcttagtatagaaatcccaattcagactggcttgaatagggaaaaagtgtggctcacatctttttttaaaaatcaagaaagaatgccactaccccatggccacaactactgcgtcagtgctctggagcccttgagctgcagctactgagtccccgcacctagagcctgtgctcctcaacgagagaagactttgaaacgagaagcctgtgtgccacagctagagagtagcccccgccctctgcaaacagagaaagccactgtgcagcaatgaagacctagcgcaaccaaaaacaaaataaatctttttttttttttttaaagaaagaatgtcgggcatggcttgatctgggtgctggaaaaaaaaaaaaaaagattgttaggaatatctttctacttcttatctctgtttttcactgcgttggcttcactcacaagctcaccccttctggacacttggcagttgccaacagatccatggttcccttctacaagttcagcagcctccagagaaaaccgtccttcccacagtgccaccccaactatgggaagaggcagagcaagcggagggggtagggacctgtctgcaggtccagtggctgagactctgcacttctgatgcagggggaccaggttcaatccctggccagggaactagatcccacaggcggcagctaagacctggcacagccaagtaaataaatattaaaggggggtggggagggtggggcaatgtgacacgcttgcacccattctgcttacgccagtctggaattttacccccagatgaatagtggaaaagagtctgcctgcaatgccggaggcgagggtttgatccctgggtggggaagatcccctggaggaaggcaaggcaacccaccccagtattcttgcctggagaatcccaaggacagaggagcctggcaggctacagtccatggggttacaaagagtcggacatgactgagcgactgagcacacatgaatagatattaatacatagtgaaagtcgggtgctcacaatccacagtcaagaaacctgaagaaagaaatccacggtaaaagtgaaggagaacaatgtccacacggcatctttgaggaaaccacgtaaacccgttagcagggacacttggcccactctgtgccccttcatgaggctccatctggcctccttggtctggccttcaatctccctgacatccagaaggcggggctcctgctgaggtctggccaggtctttgactgctggtaagttgctcacaaatccctttggggatctccagcccaactcgttccgggaaattcatgttcttttcctgtcttcagttcagttcagtcactcagttgtgtctgactctgcgaccccatggactgcagcacaccaggcctccctgtccatcaccaactcccggagttcacccaaacccatgtccactgagtcggtaacgccatccagccatctcatcctatgtcgtccccttctcctcctgctgccaatccctcccagcatcagggacttttcaaatgagtcagttatttccatcaggtggccaaagtgtcttacccctgtctttttccacctgtgcctctgatcagtatcaacacctaagagaatgatatcaatactttgttgccaggtttcagctgatgggtagatgcccctcccttcctttccctccaagtctgggagcaaagcaggccagtggtactggcatcagcattcctagtccagggatgacgaggtttctgggtcatgaagtcctagaaaccttcagtggaatctaggacagataatcatctaaaattgtcttgtaattaataagttatgcactgttccttactaagtggagtacttaccatcacattgcaacacaatgtaaaaccgttaagcctctggttcagggagaattatggctctacatatttctcaaattctttcttttgctacaaaatgaactaatgaataaattctttaagaaaaccctgtgaaatatagacactactaaacgatgtaaacaggcagaaaacaggtctacgaacttgcagtaaaacaagtagaacatactccgatgtggatgcatgggtgaggtggatgcaaacacgaacactctgaatatccactaagttaaaatggcagaagggacacagttaacaagaatatgttgaatctgtgtattaaagatattactcagccataaaaaagaatgaaataatgccatttgcagcaacatggatggacctagagactggtgtggggcttcccttgtagctcagctggtaaagaatcctcctgcaattcaggagaccctggtttgattcctgggtcaggaagatctgcaggagaaggggtaggctacccactccagtactcttgggcttccctggtggctaagcggtaaagaatccacctgcaatgcaggagacctcggttcgatccctgggttgggaagattccctggagaagggaaaggctaccaattccagtattctggcctggagaattccatggactatatagtccatggggtagaaaagagtaggacacgactgagtgactttcactttcagagactggtgtactgagtgaagtcagttagagaaagacaaatatatgatattgcttatatgtggaacctaaaaaaaaatggtataaatgaacccatttacaaagcagaaatagagtcacagatgtacaaaacaaacttatgattcctaaggggtaagggagggtgggataatttgggatattgggatggacatttatacagtattatatatgaaacatactgttaataaggacctactgtatagtacagggaactcttctcaatactctgtaatgacctatatgggaagagaatcttaaaaaggagtggatatacgtatgtgcataaccgaatcacttttctgcacagcagaaactaaaccaacattgtaaatcaactaaactccagtaaaaaataattttaaaaaattgtttgaaaaatccacctttagaaaggagaaaaacactacttatacttttttaaaaagtaaaactcaaactctgtgccaacttcaaagtaaacacaaagcactatcaaacatcttacccagtttcctgaatggactcttagcttgcctctctgctatgatcctacatctgtgtgtgtcttcaggagtgcagttcagctcagtcgctcagtcacgtccgactctttgcaaccccatgaaccgcagcacgccaggccgccctgtccatcaccaactcccggagttcactcaaactcatgtccattgagtcggtgatgccatccaaacatctcatcctctgtcgtccccctctccttctgccttcaatctttcccagcatcagggtcttttcaaatgagtcagttcttcgcatcaagtggccaaagtattggagtttcagcttcaacatcagtccttccaatgaacacccaggactgatctccattaggatcgactggttggatctccttgcagtccaagggactctcaagagtcttctccaacaccacagttcaaaagcatcaattcttctgcactaagctttctttatagtccaactctcacatccatacatgaccaccggaaaaaccatagccttgactagacggacctttgttgacaaagtaatgtctctgctttttaatatgctgtctactagtttccctggtagctcagtcgatccctgggtagggaagatcccgtgaagaaggaaatggcaacccactccagtactcttgcctggaaaattccatggatggaggagcctggtaggctacagtccacaggactgcagagttggacatgactgagcagattcactgactgactgactaggttggtcataactttccttccaaggactgacttcctcagttcagccttctttatcttcctcttgtgcataggtgccctcagggcaggatccaggttctgtttccttttgtatcttctgcttggccttacctgactcctgcctttgcccccttcattctcccagcctccggtcctcacgcgcaggcctggcccaccttgggcactggaagcagaatcaagtcccatcgagctctttgttcgttttctcattctgctctgtatccccagggctagcaaagtgcctgcacctaggaagctccccatgagcatttgttggatgaatggatggatgacgtcatgacggctgtgaaccgccgtctcacctcctgttcaggtttactgggctgagacgactccctccagctcctgctgatggccttgtgctgcctgtgtacccgccccagcactcttagctctgtcccccttgggttttgcattgacctgcgctgccctcttgtagcggtgcgggtcagcctagcttctttcccactgtcaccatcttctctggacacatgtttaaccccttgggcactgactttccatcagtgtctccttagcactcctcctgcgggagctgtccccagatcctgttcagaggtctcattcccagcatcttgccgtgcccaccgccatatggatagataccctggattaaattgttttctctctttggtcatcagctaagtcaggggaaatttacttatttttgaaaaactggaatctggtgtcctttttcacaacgtgtgtcatttcaatcacaccataaaagaagaccacacacacatcaattaaacgccagacacccatagggcattttcacccaagttggacatcagggttgctctttcaattcagcatgtgttcctacctaatttgatcatttaacagtgtttacatactgtttcacattttggagaaatcagttcataggacttccctaggggtacagtggataggaatcacctgcgaatgcagggggcaggggttcgatccctgatctgggaagatcccacatgccgccgagcaaccaaacccacgtgccacagctactgagcctgcgaactcgagcctgtgcttggtaacaagtgaagccacggctacgagaagcctgagcgctggaaggagcagtatccgctgctagccacgacgagagagagcccatgcggcagcaaagacccagtgcaaccaactgaaaaataaaaaaaatttaaatcaattgataaggtttgtttgggggaaaggagttggtaaatcaagatctctgtgatgaattgctgtgcagtgggtcttttccttgtctagtgacacagttaatgtggactacagtcctggtctcggagaccaggaaaatatgaacagtcgtataaacagagcgataagagggaggggagcgtgtttgtctagttagacattgaggtttaccattaactgtttcatcatcggtatgcatgctgcgttaacagacagcacgtgggtagctgattccaacaagaaaccgcttgtctcctgaattccaggaagtcagatattgagggggaggagggaatgtgcgtgcttaagtggataagacagacagtaccctccaatcactccaattctccatccacagacaggatgcactgggtctcctcccccccgcatctactctttgcttgcttattggcgtgttcatctcaccaccaacagacactaccgggagttttctagctcactttttcagatttcaggggcctggttgctggcctccccccaccctcaccccaggctcttagaaaacagcatgccctggacttgggctcctagcatcgcctgcctttgctgaaactgcaagtgagaaagtttacgacatgttatttcgggggttcctttttttcccagaagctgctcatttctaaggagaggctgtgataacaaaactgcttattttctttcaggtgagtttcaatgaatcggctcatgaaggggaacctggctggcccgcgctgagacgagaatggcacctccttctgggcacagcttctttctgatcggtgcgctgggcgtctttgcactcaactgcttcaccagagctcagaggaacggcacgctcattttcaccaaggaaaacaccattcggaagtgcagctgctcagcagacatccgcgactgtgactacagtttggccaacctgatgtgcagctgtaaaaccatgctgcctcttgccattgagcaaacgagctacagtgaccgtctgaccatctggttcacagacacgtctgcgctggggctcctgctgaacttcacgctggtccgggacctgaagctttccctgtgcagtaccaacactctccccactgagtacctggctatttgcggtctgaagaggcttcgggtcagcacggaggccaagcatccctcccctgaacagagtttgctcatccacgacggtggggagagtgaacccagagagaagcccacgttacagcgaggctggcaaacctgtatgtatctctccttcttagacatggcactcttcaacagggagtctgccttaaaatcatacagtgttgcaaactctgccagcgtggccaacaacttcccctacttttcctaccttaaaaccttcccagttctaaacaacaaaagctatgtggtcaccttcatttactaatatcgtagctgtgcccatcctccggggactttggcatctgctggatcatctcaacaagggatctgtgaacaaggtcatgggtattcctagcctcaacttcacttctcctccagcctcctttcacacagagccagccctctgctccacccacacctggccctgggaaaacaaaataaaaataataaaaaaaacctacttgattcagtctataaacatatgttgggggccagctagaggctaggtttttgctactaagggagggtagggaaatgtcagatcagtgcaccccaaggactgcttagtgcagctcagcagaggggataaaccctaaagaaaggagtcttccagatttcgctggtgatgcagcgattgacacttgcctttcaatgcagggggtgccgatttgatccttggtcagggaactaagatcccacatgcctcgtggccaaaaaaccaaaatataaaacagaagcaatgtgtaacaaattcaataaagactttcaaaaactgaaagggaactgaaagtgttagtcgcccattcttgtctcactctctgcaaccagtggactgtagcccactaggctcctctagccatggacttctctaggcaagaacactggaatatgtagccatttctttctccaggggatcttctcgacccagggatcaaacttgggtctcctggcagattctttacaatctgccatctgagccaccaaggaagcccttaaaaaaaaaaaaaaagcatcttccttcaaaacattgccttttttgtcccctccttcatgttcttacataggctggaattcccctacatagagaatgacagacttcagtggttttgcgacaaggagcccctcaaaatgattagatcctcttagactggtattttccaaacatcttgtaaagcacattcacactgagaaagggaagtcttgtgagtgtgttcagtgacggggagtggcgggtggtgccggtggggagggttgaagcctggcggatatggtggaaacttagggctgaataagaacatcagggtccgagagggaagtcacaaaagccaagtgcatttgggatttttgttgcttagaaagaggcctaaatccggggaatgctctctccctctagcccttctctccctctcttgccttgccacctcctacctttggcccagctacacagcttccccactgttcctcccctcctcctcctcctgctccagaaatcagagcttagattaataccactggaactgtgtttgactacattaggggctagcctgggaatgtaataacccctttataacactactcgcatgggtaaatacatccagattacttatagataattaacagaagaatttttagggctcagtccatttggaagtttaagactggaaagtgaagacactctgtatgatggggttaacataaaatgcttttatgtgtgttcatacaaagaaccaaggcaatatttttcattaattttccctggagaatagctgctttacaaagttgtgtcagcttctgctctcagcaaagtgaatcaccaaacggatacatgtatcctcccttttttggatttcctcccgtttaagtcaccagcaagcacagaggagagttcgcagtgctggacagtgggttttcatcagttatctattctatagatagtatccatttttaaaaattaaactgactcatcattggacaaagaaaatcttccttcacagaaacccaactccacactaaaatgggatataaagaatttgtggcaattatggtacaaacacctaaacccagaaggcagaaagttggaacgtattgaatgcatgataccgtaatgataagaaatagttctaccatgaaataacacgtatttttctcttagccttaacaccagatagctgaaataacctgaaatgtttccatttgcttaactggtgagagatttggccattcagactaattagcatgcatctataatatcagtgcttgaattaggccagaactaagaccaagataccaattttaatagaaagatgtgatgaccttattactgacattgtatgtgagaggtaagattaaagtggtagaaaaagataaataaggaaacaaaagagagagaaagaatggcaagaaggatatagatgaaaagattaatattaaatgtatttactgtcattagttactgaaaatgtaacaaatggaattttaataatttttatttataaagtataaaatttactgatactacaaattatgagtatcttaatgtgtatatcttccatttggtgacttttaatagcttcagagctctttcacatatgttttaagtaattcttacaagaaatacttcttgggtcccctctggtggctcagtggtaaagaatctgcctgtcaatgtaggggacacaggtttgatccctgatcctggaagaccccacacgctgcagagcaactaagcctgcgtgcacagctactgaaccggagctctagagcccaggagtcgcaactgctgagccctgcaacagttggggctgttgcaacaactgttgcaacaacaaagcagttgcaacaacgcactgcaattactgaagcctctgctccccaactggagaagccaccgcaacgagaagcccgagcaccgcatgcgagacagcccccgcccaccacaactgcacaaagcaacaaagacccgatgcaacccaaaacaatgctttaacaagcgaacaagaaaaacgtaactagtatacagtggaactatatgtaaccttgctctgcattttctgagtctcctataaatgtgttattatgttttcataattaaaaaaaaacaactcatgttccaaatacaaaaaaaaaaattctgaacacaatgataaattcatctttgataggaagaaggtcacttttttcagtttcctgagtgaagccaagagaagtacagatgaaagtgggtgtgtagatgtggttccctccaatgcttctctattgttagtaaaggattagctagttattagctggggatagaaggaaggatttgagaagaggtgtatcataatctcatggtttggcaaagctggtagctcagaggttaaagcgtctgcctgcaacgcaggagacccgggttcaatccctgggtcgggaagatctcctggagaaggaaatggcaacccactccagtattcttgcctggaaaatcccgtggacggaggaacctggtaggctacagtccatggggtcgcaaagagttggacgactgagcaactccactttcttttctttctatgggaaagtaaacttaacaagggaacattaaaaatacgggacagataaatttgttgaaatcccaaaggtacagatggctctctcatgatctcttcattgccatatgttcacatgttttaaaactttgccattatttctctggagtgatgggaacaggaaacgataaaaacacatgattattcccatgtcattaactcaaaatctatttacctcttccaaaactttcccacttctttgcttattggtttgttaagagccgttgttgttgttctgtcgctacgtcgtgtctgactctttgtgaccccatggattgcagcactccaggctttcctgtccttcaccatcacctggagcctgctcaaacttgtgtccattgagtcggtgatgccatccagccatctcatccttcgtcgtccccttctcctcctgctttcaatctttcccagcatcagggtcttttccaatgagtcagctcttcgcatcaggtggccaaaatattagagctttactgtccaatattccagtggatattcagggttgatttcttttgggattgactggtttgatctccttgctgtccaagggaccctcaggagttttctccattaccacaatttgaaagcattatattcttcttaaatcagttgtgaaatttgtattttgccaaaatatacattttctgtagaatttccaatgtattgtcactgagtaccatacaacattttctcacaattaatttggctcttcgtcatgtctacttatagttaaagttttgggggatatgtatgttccttaattaagtttgagtttttcttggtaatccctatgtttggggttttattttattttctatttattttttattagtaatcattttatctttgactatttctactatacacattctttgaattgttttgctgtttttttttctttgtttttctgaggctgaatatttctcttttcacttgtgtaattataaacttagtttatttttttccttttttaaaatatgaatttatttattttaattggagggtaattactttacaatattgtagtggttttgccatacattgacatgaatcagccatcagtgtacatatgttccccatcctgaactcccctcccacctccctccccaacccatccctctgggtcatcccggtgcaccagccctgagcgccctgtctcatgcatcgaacctggactggcaatccatttcacatatgataatatacatgtttcagtgctattctcccaaatcatcccatccttgccctctcccacagagtccaaaagactgttctatacatctgtgtctcttttgctatctcacatatagggttatcgttaccatctttctaaattccatatatatgtgttagtatactgtattggtgtttttctttctggcttacttcactttgtataataggctccagtttcatccacctcattagaactgattcaaatgtattctttttaatggctgagtaatactccattgtgtatatgtaccacagctttcttatccattcatctgccgatggacatctaggttgcttccatgtcctggctattataaacagtgctgtgatgaacattggggtacacgtgtctctttcaattctggtttccttggtgtatatgtccagcagttggattgctgggtcatatggcagttctatttccagttttttaaggaatctccacactgttctccatagtggctgtactagtttgcattcccaccaacagtgtaaaagggttcccttttctccacaccctctccagcatttattgcttgtagacttttggatagcagccattctgactggcgtgaaatggtacctcactgtggttttgatttgcatttctctgataatgagtgaggttgagcatcttttcatgtgtttgttagccatctgtatgtcttctttggagaaatgtctggttagttctttggcccatttttttgattgggttgtttatttttctggaattgagctgcgggatttgcttgtatatttttgagattaattctttgtcagttgcttcgtttgctattattttctcccattctgaaggctgtcttttcaccttgcttatagtttcctttgttgttcaaaagcttttacgtttaattaggtcccatttgtttatttttgcttttatttccaatactctgggcggtgggtcatagaggatcctgctgtgatttatgtcggagaatgttttgcctatgttttcctctaggagttttatagtttctggtcttacgtttagatcttaatccatttttagtttatttttgtgtatggtgttagaaagtgttctagtttcattcttttacaagtggttgaccagtttttccagcaccacgtgttaaagagattgtcttttctccactgtatattcttgcctcctttgtcaaagataaggtgtccataggtgcgtggatttatctctgggctaaagttatacattattctgtgagtccccctttaggtatgtaccatatagggaaatgacacttttatatgtcattataagtgtcataaaaatgacacttttattaatttctagagatcttagataatgtatgtcttatttcccctttgatttagagatttagatgactgttcattaattcccaaatagctaagacttttttttttgtattggaggggtcattcagcttcctggatttggctcatcatttaacttttttctctggttggagaacgttccctgtaaaaatctctgttttgaagaatttgttcagttatttgtttacccaggttaatgattgatatttataaatgtttcacagatgccatgggtaattgaatagtctctgtttggagagaacataattttattaatctatatatttgagctcactgattatattattaaaatcctatataaacttatgcattatttgactacttcatctgcctgattcagacagagacccacatacaaataataataaaaaataatgtatttagtgtccatttgatgtcttcagttaatttaagaggaaatctggaaagttaactaaccagggacagatacagagaaggtcacagtctggctcagctatggctagggtttttctgaatgagtacaacgaaccattcaatcctaaaggaaatcaactctgaatattcattgggagtactgatgctgaagctaaaactccaatactttggctacccgatggaaagagtcaactcattggaaaagaccctgatgctgggaaagattgaaggcaggaagagaagggatgagaggatgagatcagaggatgagatggttggactgaatcaccagctcaatgagtttgagcaaactccaggagatgataaaggacaaggaatcctggcctgctgcagtccatgcggtggcaaagagttggacaggactaaacaacaacaacaaagcaggagaggggaaggaagctgagcttgtcggaagggagtgactataatcttgtccccatgaaatccaatctggatgaggcaggaaacaaaggcaggaggaagagaatgggcagtgaaaggtgatgggttctggactggaggtggaatagacaaactagaagatggaagtgaagttttaccaaagtgaaagagaagtcgctcagtcgtgtccgactctttgcgaccccatggactgtagtctaccaggctcctccctccatgggattctccaggcaagagtactggagtgggttgccatttccttcttcattgagaagttggagtgagttggaagttttaccaaggaagatgccaagtaactccctagtaacttggagaagatgcaagttgcaaactccaagatgcagtccttatgataagattagagtgaggaggttagagaactaactccaagtagaagttgcactggaatgttgaaaacatgaagaatgagagagtgaatgttcataaaataattctggaaagaaatgctccaaaaattaagtgttaagattaataacaattatttccttctttgtattgttctgcattttcaaaatttctaaaatgtagtaatgcaggtagcacttttataattagataagggacttccctagtggctcagatggtaaacaattcgcctgcaatgcaggatacctgggttcattccttgggttgggaagatcccctggagaagggaatggctacccactccagtattcttgcctggagaatcccatggacagatgagcctggtgggctacagtccacggggaagcaaagcgtcggacaggactaagcaactaatactttcaaaggttatttttaaaagtccacttcattttttcaaaaatttggagcttggggacttatctggtggtccagtgattgagaatctgcctgccagtgcaggagagacaggtctgatccctggtctaggaagattctgcttgccagaacactctagagcccgtgatccacaatacgagaagccaccaggatgagacgctcatgaaccgcagctagagtgtagccccctctcactgcagtagagaaagtccacaagcagcagtgaagactagtgcaaccaaaaataaacaagcaaacaggatattttaaaagatctgaaaaattcaaagcttgatttgatgcctcgctctgtaatcataccatactgttactctgtatttcttgcgcaattttgctgccctggagtaaaattaaatagcacagaaaaaagacacattccttcatctttcctcccaaaagagatacatgtaactctgttgtctttgataaggtatctgcttttgactttttccccaagaaggaaagacaacaatgtctgaacgattttgagctaatagaggtgaattctcttagaaaggatgcatagctatttttgcttctgtattggttgtatagtccttagatgtatttataaagagtttattgtgaatgtaatataaatatcacatggtactatgattatgaattgtacttgttgacatactaacaccggaagatataaaacactaaatcagacaaaatgatttgttattattcagtcactaagttgtggctgactctctgtgagcccgtggactcagcacgccagggttccctgtccttcactatctcccggagtttgttcaaactcatgtccattgtgtcgatgatgcgatccaaccacctcatcctctgttctcccttctctttttgccctcaaattttcccagcaccaggttcttttccaataagtcagcttcttgcatcaggtggccaaagtattggagaagggaatggcaaactacttcagtattcttgccttgagaaccccatgaacagtatgaaaaggcatgaataacactggagtgggttgccatttccttctccagaggatcttcccaacccagagatggaacctgcctctcctgcattgccagcggattcttcaccactgagccacctgggaaggactgtgaagctagcagtgaaaaaaacaaacaaacaaacaaacaaaatctcctcccccaggaaccttacattttacattaagttaatgcaaaactgtcttcgctaaatcaaggacaagaaatttaatgaaataattaaatgttttctccagctttttgccccccagaatagaattcttgagttatttaggaagaaaggaaaaatttgtagaccaggaattcctagactattagattttgcatgccacataaaatttttagatataacaaacaatttggggggacttatagctttcactacttttcagttggtcaaataagggtatgaaaacaaacaaaatataccatcatcattatttcatttaaggaaagagattttagtatcttagtatggaaggaggaagatgacctcagaacaaagcaccattttctcccccctgataagagacatctggctactatacatgagcagactgttcgtgtgcttctcatttggcaactgactagggaaaacttcacgggctcacagagctacatttggtaatcattgtctcaggttacagagtctaatactgagttggcaaacaaaacaaacaaaagtggtttgcctattttgtctgaaatcatgggtcagttattccatgcagagtcacaatttagtagaaaaaaaaactaattgggattattgcttggaaaggtaactttaaaaagcactgggtatgacacatatgcacagtggaatattactcagctataaaaaggaatacgtttgagtccaaacgaggtggatgaacctagagcctattacacagagggaagtaagtcagaaagagaaagacaaatatcatgtattaatgcatatacatggaatctagaaagatagtacctacgatcctactggcagggtaccaaaggagacaccgatattttgtgacacagtgggggaaggagagggttggatgatatgagaaaatagcatggaaacatacattaccatatgtaaaaaagatagccagtgggcattcgaggtgtgacacagggaacccaaagctggtgctgtgtgacaacctagaggagagggatgggaagggggggtttcaagagggaggggacataggtatatctaatgttgactcatgttgatgaatggcaaaaactgtcacagtactgtaattacactctaattaagaaaaaaaaaatcactggggacctccctggcagtccaactaagactttgccttctgatgagggggtgtgggttcgatccctggtcgaggagctaagatcccacagggctcacagctaaaaaatgaagcgtaaaacagaagcaatataaacaaaaaattcaagaaagactctcaaaatggtccacgtgatcaaaaaatacaacaaaatttattttcttaaaaaagcactgaactgattcaaacaatgatggacgcaagcattctacgaaagcggtgtttgtctaaaaacactccaacattaaatagtgatgctatgctgtaaacagtcagtttaatactcagtgcacagagcagtttataaaataattagtttcagatcatatactggccgacaggcgatgaaagcagctcttctgtttcaggaatttaatttctacaaggtctgtaatctctagaagggcctttgacttgtgttagcagcaagataacttctgaatctttaactttgcccttcaattatctgaataggtagattataaaagttataaatacatcgtggctttttatttgttagcttgatttaaaacaaccaacattctcctctctatccatatttaatcatcactttcatactggaagaccgttttgaagtttcaggccaagatattaacacagtctgctctgaaccttatctttcttacctctgtcctaatcatgttactgcaagtttgtcttttggcactggcactggtgtctacaggctgaccaggcacaatttgaagcttttgtgatgagaactggagttcaatttcaccaacgaaacactctgctggaatcagaacttaatgctgaacagccagaatataagaacttagagtaatgcgagtagaatggaagccagatgttattaactttctctactaactggaataaaatgttacagaggacactctcagcctagatcatctttctagctttcaaaagtgagtcacgggtgggcagatttcaaatgcaatcaaagaaaaccagtgaaaagagccagttgtgtatgaaatcttgagcttgaaatattttgcttcagcctgcaacttaaatctcaagtgaaattttgacagaatggtgtaggcaaacagacactgtggtaggagtacaaactggcatggttgggagtgggcgaaatgaatgaatggggttaaaacgtatataagtcatgggaatgtagtgataaaatataacttgatttggtaaaaaatactatattacagaaaaatactatattacatatttgaaagttgctaagagaatggatcttaaaagtgctcatggcaagacaaaaactctgtagctacacgtgatgaaagttaactaaactcttgtgatcatttttcaatatatgtaaatattatatcattctgttgtacatgtgaaaccaatataatattatatgtcaggtgacttcatttgtatttccctggtggcttagtggtaaagaatctgcctgtaattaggagatgtgggtttgatctttggatcaggaaggtcccctggagaaggaaatggcaacccattccagtattcttgcctgaaatcccatggacagaggagtttggcaggctatagcccatggggttgcaaaagagttggacgtgacttagcaactgaacaacaattacataaaaaaaaaaaatttttttttttaaattgcatgctgctatagagagcggcttagaattggcaaaattacaaatgcacacctgtggatctagtaatttcaataccaattcatcctactcatgaccatttttcaaagcttttcatcacagtattgattatcatagcaagattggaaaaaacattaataccaattcttacgaaactacttaaatattaataaattatggtacatttgaacaatggatcactatgcaggttggtagaagggacaacactttatgaacagatatgaactgatgtccaatgtatgttagactaaaaaagtaagttacacattgtattaaaaaaaggtaattcataaaatacacatcttcatttttatgttcaaagaatatctcttgttgttccatcactaagatgtgtccgactgtttgtgactccatgaactgaagcatgtcaagcttccctgtccttcactatctccgatagtttgctcaaactcatggccattgagtcagtaatgccatccaaccacctcatcctctgctgcccccttctcccgtcctcaatctttcccagcatcagggttttttccaatgagttggctcttcaaatcaggtggacaaagtactggaacttcatcttcagcatcagtccttccagtgaatattcagggttggtttcctttaggagtgactggtttggtctccttgcagaccaagggactctcaagaagatgagtcttctccagcactacaattcaaaagcatcaattcttcaacactcaaccttctttatggtccaactctcacatctgtacacaactgttggaaaaaccataggtttgactatccagacctttgttgacaaagtgatgtctctgtttgtaatatgctgtctaggtttgtcatagcttttcttccaaggagcaagtgtcttaacttcatggctgccatcaacatctgcagtgattttagagcccaagaaaataaaatctgtcactgttttcacttttcccccatctatttgccatgaagtgtgggactagatgccatggtcttcgttttttgaatattcagttttaagccagctttttcactctcctctttcaccttcatcaagaggctctgtagatcctctttgctttctgccataagggtggtgtcatctgcgtatctgaggttattgatatatctcctggcaatcttgattccaacttgtgagtcatccagcccagaattttgtatgatgtactctgcatataagttaaataagtaggatgacaatttacagcctttttgtactcctttcccaattttgaaccagttcattgttctatgtctggttccaactgttgctttttgtcctacatataggtttctcaggagacagatgaagtcgtctgatattcccatctctttaagaattttccacagtttgttgtgatacacatagtcaaaggttttagcgtagtcaatgaaatggaagtagatgttttttcttttttggaactctcttactttttctatgacccaacagatgtcggcaatttgatctctgccttgtctaaattcagcttttacatccgcaagttcttggttcacatactgctgaagcccagcttgatggattttgagcattactttgctagaatgtgaaatgagtgcaaccacacggtaatctgaacattctttggcattgcctttctttgggattggaataaaagctgacttttccagtcctgtggccactgctgagttttccacatttcctggtgtactgagtgcagcactttcacagcatcatcttttaggatttgaaatagctcagctggaattccataacctccactacctttgttcatagtgatgcttcctaaggcccccttgacttcacactccaggatgtctggctctaggcgtgtgaccacaccatcgtgtttatctgggtcattaagacatttttgtacagttctgtgtattctctccacctcttcttaatctcttctgtttctgttaggtccttgccgtttctgtcatttattgagcccatttttgtaggaaatgttccattggaatctccagttttcttgaagagatctctagtctttcccattctattattttcctctatttctttgcattgttcacttaaggctatcttatctctccttgctattctctggaactctgcatttagttgggtatacttttcctttctcctttgcctttcacttcttttctcctgctatttgtaaggcttctttagacaaccacttgccttttggcatttttctttgggatggttttggtcaccacctcctgtataatgttacaaacctacatccataattctttaggcgttctataagatttaatcctctgaatctattcattacctttactgtataatcataagggatttgatttaggtcagacccagataatcatgatggtgtgatctcacctagagccagatatcctggaatgtgaagtcaagtgggccttagaaagcatcactacgaacaaagctagtggagatgatggaattccagttgagctatttcaaatcctgaaagatgatgctgcaaaagtgctgcactcaatatgccagcaaatttggaaaactcagcagtggccacaggactggaaaaggtcacttttcattccaatcccaaagaaaggcaatgccaaagaatgctcaaactactgcacaattgcactcacctcacatactagttggagaaggcaatggcaccccattctagtactcttgcctggaaaatcccatggatggaggagcctggtaggctccagcccatggggtggctaagagtcgggcatgactgagcgacttcactttcacttttcactttcatgcattggagaaggaaatggcaacccactccagtgttcttgcctggagaatcccagggacaggggagcctagtgggctgccctctatggggtcgcacagagtcagacacgactgaggtgacttagcagcagcagtagcagcacatgctagtaaagtaatgctcaaaattctccaagccaggcttcagcaatatgtgaaccgtgaacttccagatgttcaagctggtttaagaaaaggcagaggaaccggagaccaaactgccaacatccgctggatcatcaaaaaagcaagagagttccagaaaaaacatctatttctgctttattgactatgccaaagcctttgactgtatggattacaataaactgtggaaaattctgaaagagatgggagtaccagaccacctgacctgcctcttgagaaatttgtatgcagatcaggaagcaacagttagaactggacatggaacaacagactggttccaaataggaaaaggagttcatcaaggctgtatattgtcaccctgcttatttaacttatatgcagagtacatcatgagaaacgctgggctggaagaagcacaagctggaatcaagattgccgggagaaatatcaataacctcagatatgtagatgacaccacccttatggcagaaagtgaagaggaattaaaaagcctcttgatgaaggtgaaagaggagagtgaaaaagttggcttaaaactcaacattcagaaaactaagatcatggcatctggtcccatcacttcatgggaaatagatggggaaacagtggaaacagtgtcagactttatttttttgggctccaaaatcactgcaggtggtaactgcagccatgaaattaaaagacgcttactccttggaagaaaagttatgaccaacctagatagcatattgaaaatcagagacattactttgccaacaaaggtcatctagtcaaggctatggtttttccagtggtcatgtatggatgtgagagttggactgtgaagaaagctgagcaccaaagaattgatgcttttgaactgtggtgttggagaagactcttgagagttccttggactgcaaggagacccaaccagtccattctgaaggagatcagccctgggatttttttggaaggaatgatgctaaagctgaaactccagtactttggccacctcatgcaaagagttgactcattggaaaagactctgatgctgggagagattgggggcaggaggagaaggggatgacagaggatgagatggatggatgacatcactgactcgatggacatgagtctgagtgaactccgggagttggtgatggacagggaggcctggcgtgctgcgattcatggggtcacaaagagtcggacacgactgagtgactgaactgaactgaatggtctagtggctttccctactttcttcagtttaagtctgaatttgcaataaggagctcatgatctgagccatagtaagctcccagtcttggttttgcagattgtatagagcttctccatctttggctacaaagaatataattaatctggttttggtactcagacggtaaaagcgtctgcctataatgcaggggacccgggttcgacccctgggtcaggaagatcccctggagaaggaaatggcaacccactccagtactcttgcctggaaaatcccatggatggaggagcctggtaggctgcagtccatggggtctcgaagagtcggacaggactgagcgacttcactttcactttctattgagcatctgatgatgtccatgtgcagagttgtcgcttgtgttggaaaagcgtgtttgctatgatcagtgtgttctcttggcctttgccctgctccattttgtactccaaggccaaacttgcctgttgctccaggtatctcttgacttcctacttttgcattccaaccccctatgatgaaaaggatctctttttggtgttagttctagaaggtcttgtaggtcttcatagaaagaatcaacttcagcttcttcagcctcaatggttggggtgcagacttggattactgtgatactgaatggtttgccttggaaacgaactgagatcattttgttgtttctgaaattgcatccaagtactacatttcagactcttctactgaccatgagggctactccatttcttctaagggatttttgcccacagtaataaatataatggtgtgaattaaattcctgtgatcccactaaagactgagatagatccgcctgtcagcgttgaagagctcctgcagcggtatgggttggcagtagcctgcctgggggacagggtcaccggcagcagcaatcctgggaggcatgtattggcataagtcctttttgaaggttgccagtagttctaccatagagcctgtagactctagtattgagttgcatcagggcataactaacatagcatagatccaaatatcagcagacaattggattaaagctttactgagcatggccctaaccaccagagcaatacccagattttcccacaaccagtctctcccaccaggaagcaagaactataatcccacaccctccagaaaaccaggatcacacaaagctaaccaaaatcatcacacagataacagtcttgttctcaaggatgctatcagccacctgagggccacccaagacttgacagctcatggtggagagttctgagaaaacagtccactggagaaggggatggcaaaccacttcagtattcctgcctcgaaaaccccatgaacagtatgaaaaaacaaaaaaaaatatgacactgaaggataagctccccaggtcagtaggtgtccaataggctactgtggaagagcagagaaataactccaaaaagaatgaagaggccgggccaaagtggaaatgtagctaagttgtggatgtgtctggtggtgaaagtgaagtctgatactgtaaagaacaatattgcagaggaagctataatgttaggtccatgaatcaaggtaaattaggtttagtcaagcaggagacggtaagagtcaacaccaacattttaggaatcaatgaactaaaatggacgggaatgggtgcatttaattgagaagtcttctggaggatcacaaaaagttcaacattgccagcgaactggaaagtgcctagaaatggatgtgaatacctcttgtaaccttttcaattttgaaacaagaaaattcacatataggcacataggcgaaggagaaggccctacattcggtgacacagtgagaaagtaggtgaactcaacttcagagtcaatgtgcccttgccagtttaaagggttacctctgtgacatgtctgaaatgtgtctcgctacgtcgattttttcctacacttgtttctgaaatcagccaagttgaggaacggctagcaaacctggccttcttttgaaaaaatcatggacacttttgctttcattgtaatagagggaaaggtgctaaaaaaaaaaaaaaaaaaggccaaataacattttatcctatatgacactccgtctttttgaaagtgctcttaaatcatgaaggtgtagaaatatgacgtactaataaggttaggcatattaatacatcacggctcagtaatctggcctagagaattccatggactgtatagtccaaggggtcgcagagagtcggacacgactgagcgaccttcatttcacttcactcaattcagtctcaagaaaaaatatcgcacccttgggattccacttccagctcctccctacctcctcccgttccaccttggatctcctccttccctccccactacttctccgcctttcccccgtctcctccttcactatctgctcctcccagcgcttgtcgggaggtttcctcgcgtgactacgtcatgagggagacgcactgcagcacccggggctgactctttcctctcgtctctatgattctctttgtgaccggccggacggctccggactcccagagttccgttccaatagtcctccgggccgacagggggacgccgcgggtggggtcgggatggggtggggaacaaaacaaaactgacgttctcgcgagaggggaggagttctctccaatctttgagcgcgtgagcgcctgcgcgctccccgcggtgcgcggtagctgggaaagggaaacgaggagcccggctggactcccggggagatcgcgcgtgcgctgtcgcgagctcggcgctgccggggcggctgagttgggagccggctggtgtgtgtgtgagagcgccgtgcgggacgcggggcaatgttccgaaaggcccggcgggtgaacgtgcgcaagcggaatgactcggaggaggaggagcgagagcgcgatgaggagcaggagcccccaccgttgctgccgccgccgcctggcaccggcgaggagcctggccccggcggcggcggaggcgacagggcccccgcgggcgagtccatgctggtcccggggccgccgccgccgccgccgccgccggccgcgctgacctcggggacagaggccgggggctgcctccccggcggcttggagcccggcaacgggctgaagccgcgcaagaggccgcgcgagaacaaagaggtgccccgggccagcctgctcagcttccaggacgaggacgaaggtaaaccgccgcgcctcggggggccccccggaccccgggatctctatcctagctaggcctccaccgcgggtccctgcgttcccaggacgctcccagcctcagcatccccgccccccgccccgggaacccagtcgcttcttcccgccccgacccgctgcacgtcttcccccgcctccggccttctgcgcaggcagggtggtgggggggggcggtgggggggatgtgttcccgcgccgccgccggccttctcttaactaccgcctcctcctcgccggcctcccgagcatctcctgtcccgaggggatggggacctaagatcagtcattctgagttttttttcacctggaaattcagtgtctccttgtcctgcctcgttcctagccgctgtgttttagggagaaccagactgctctattagatggctccctggactgccctgggcacgttctccgggccttccgtaggtccccgtgcccacgcctcttggtatgctcgccctggtcagacatccttgagtaggaaggggccagacatccttgaccagaaaggcttagtgtgtcaagaggagtgctaggtctggaaagagaagcctatagttgaagctctggttccgagtcactttgggccagcccttggcgatcgccgatcctgtttccgatcctcagtttccctgtaaaagcaaataggggtacaaatgtgcgaccttaactcgcattaacatttggatggtgaaaagagacggtgtaatggtaattcaaggcggtttatccaatctggtgtgaggggccaggctacagtggatttagatttctgatcgtagatgagccttctatcattttacttccccaattgttgagtgtatgtttgtataatccagttaagtctatgttatgaaaaaagaatttaagacttttggaaatctgacttgcatcttgatgcgcgatgttttcttgtttccagtaataggcagtttctgaagtttgccaggagtacagtcacattttcgttttcgctgatgtagggacagcttggtaaagtgtttgcattgacgtttaaagttttcaaatcaaagatgatggatacaccatcgaaatttatttttgaaaagttgattagctctcagcttggtcttgaaataactgtgtccgtgtgtgatgggttatagagttactcagtcttgacaggtctgtaaactagcaccttttgattttggatattttatttaagataccttaagaatttgataattaggtgcttttttgaagatctcttttcctctcctgaaataaatgatttaagaaagacagtagaacacagaactttgtgcagttacatgtgttatgcctttaaaaagtctcagattggcattttattccagattatgaagttgattcagtttttagaagccgattacggattttaagtaatttcaacttgtgtaatgatttggaatgtttgagtatatttagaagaattcaaaagttagaatggaaaatattgaatgaaaatagttgctacagattttgtttattttttaaagaaaatgaagaagttttcaaagtgaagaaatcaagttacagcaaaaagatagtaaaattgcttaagaaagaatataaagaagatcttgaaaaatctaagattaagacagaactcaactcatctgccgacagtaagtactaatttgattcttttgaagtgacaaaatgaaactctcacagggattgaatagatttggtgtatatacagtgaacttgttcgcttgattctgtcattgtcaagggctcaagttgagtaatgatgcagttttatttaattccaacatgactgcattgtgaatgcattatttagaaagacagaaccattgccactggaatgtttctgctgcagtgactaaattcttccagttttctgactagtgttccaagtgctgttgaacagagagaggtttcccacttaaacctgagacacagtttgtttttgtttgaaggagtactgtgcaaattcctgtacttgtattctgtacttatattttgtagagacaagttttgggttcctttggttttatttacacagtcattttaattcttcgagaatgtttaggaaccccctaagtctaatgttgataatgttcccatttagcagccttatcagatacatgaatgctcactcctgggtgtgtggcacctgcctacattgtacaaaccatctcttatgtcttctcacagactaagttaaacttttaagcatttatttgtccttaggaaagtggtttcatgataatatgctgtggtctagttattctcacgcaaatgctttagggagatctttttattttgtggaattaaagatagaaattattattgcccagttctccactataggcttgatgtgggaacgtatgtcattatatctcaagtttgcaatctaattttggagacaacatcacttcagtgtataactgtatcccgaatttggcaaaatgtctagtgagtgacttaaagcttaactgcacttttctttttagagatgggtgaaggaatgcttcatagataaagtggaatttgaagctggatttttgatcttttaaattgcaaagaaaataggggaggtgtgggcctattattcagagacttgctgttttggaaaagagcaagtacatgtgacaggctgaatagatgatgtgtgggggatgcagaggtttaggtgaaaggtacgttgttgacagattgtgaagggtgtttagtatctagtatgaggtttagagttgccatttcaggggcctgccaggatggtgacatgataaatgccttttgaaatcttaaccaggtgttagcatgcagcatggattggcacaggaaacattagaggcctaaagcagtttaaatgcaagggccagctttgatccagtaagagtgggtttaaaaaggtctcagttgagcaagactgaggcttttcctgactcagtgggaaattgtaggtgaatttaaaatgtttgctgtgggtgtggggaaaggaatagaaaaagattatttaagaagtattccaaaggaagaattggtagacgtaatgtatgcttcagctattggatctaaaagaaatagatttgagcttttgtgccaggtgactgagaggataattatgtatgatatacagaaatagggaatgcaggtgggaggaggagtatttttaggggaactgattattttggagtctaggaagctgcttcattttttccagatctcttaagaaccaactgtgtatgatgaaattgaagaagaaagctcaggaaaagtgagaactgagaaaagaccatttactgttgggtttaaaaattgaagcatgtgcaaagtttatgtggccaccttgttttcatattaactgatttcctacttagcagataactcaattaatatcctccccaaaggtagaggtcgctgttgctgtttcattaatcagctcacaatcccaaacttttcctacccccaaccctccttagataggcagaggtgcattaactggaaaacaagggtagtatcaacttagaaaacctaccttcgggatattccaaattgatgagttcacctttgaacttgaatttgggtagaaatagccagtgaatagttggagatgtagattttgttttggtgttcattgaggtgatgattgaagccaggggtaaatggaatcgaggctgcagcataaaggaaatattcctgaggaccaaagacttcacctgtaataagtgtacacatagagaggatggtttactcaagagatacaaagagtcataaagtccaaaggagaacagatagggaagtttcaagatgatgagtgttgatgagtgtcagttgtatgaaatagtatcaggaaggtcaggaaaaggaagggctgttggtgtggtggctgggttttgtggggagcgggggaggcatctggcaaaagagactaatttacttgccaagctctgcctgtttaggggaaggaacatggtttgctaaattgctcagtgatactgtatcagttagctgtggctgcagcctctgctttagttggtgagcttggaatgggagatatcaaagactgtttgccaaggtcgagactggcaaactggtgaggaagtgggaggttgcaggtccacatggctgctttggaacatttggcagagagtagatggcaatagctagagaaatagttgggatcatgttgaagttcttttgctaaagagaagcctgtgtcgctttgtagacagaatagaggagatggagaacgtgcccacagtcagaggaggatatttgtggcctcaggtttcctaaagtagcgaagacattgaggcccaagaggagcctcagaaaaggttattcagcctctctttttataaagctgtctggaaggataatacaggactaacaaaaattcacctgtcaccatgttctggactttgtatttgctctgtcacaagcaaataacttatgaacttactacaacactgagtctgcaggaatcatctgggcatactggatcaagtaaaccttttcgcaattctgtttgtctgttaaaagccattgatttagtgttaattgagagcaaaagcaaatgggtagttcttgactcccggtatctttatgcatctgataaagtgagttttaaaatcagcctcagaatgcacttcagagggaatctgtggcaatgaggtagagtggtgaattaaaaaaatttaagagatctgaagcagagtgacctaaatcttctaagtaaagttgtggggcagggggtgagggggggtaggatcttatctccaggattcttctttagaggagtaggagatgtaggagatggtttgagaacgttcgaagcagttttggggaggggcacatgctagggaaacaacagaagtgtatctttcatatttagaatgaactttttgtttcactctttcattatattcttggtgcctcgtatgtgcattgccaggttcagtgattgagggcgaaaaatgcctgtttttctgcattttgcctggggtggaaggtgtaataggactatatagttataagtaaagtaaaccatttggtataaacctctgtgacagtggtgccccctggaaccctgtggcaggaaagtagtctgaagctggcctccggaatggcctgcggaagagagagctctcttctctgtccatgtgatggggtgtagcgactccacagctgccttcctggtttgcatgcggtggtttttagtgctaactagtttctaacttgtctctgtgtcccagttccaggttgccagaaaaatcaggtttagtcacaaatccactgttccaaacattcagttgtggcaacagcctcaggggtttacacaatgtaactgtgacttttgggtctccactcttcagatgatggttataacctaagacaatatcctataaagtgttcattacagagaagtttctatcttgttcttgatagaaagctgcctcaaatgggcttccctggtgattcagacgttaaagaatctgcaatgcaggagacccaggtttgatccctggatccggaagatcccctggagaaggaaatggcaacccactccagtattcttgcctggagaatctcatggatagaggagcctcgggggctgtagtccatgggggtctcacagagttggacatgactgagagactaacacagatggatttagagtttgatgaaatactgacatataaagtgaataatgctcccaagaggtgagaacagttacctatgagagttgagaggaagaagttagttttggtaaagtggtaaactttcaataacgttaactaaaggcagggattgggcagggccatgcgtccctctaccctctgtattgtttctgcctcctggctggctactgtgatcatgtcacatgtcagaagtttgaggatttttataaacaattagaatagttgatgctttaatgaattgagcctataattgcattagaagtgcctccttaatttatggattttgttttagatatgttgtattatttatttattttttccaaaatgtagacgaaccacctttggacaaagcaggtcatgttaaggacaccagtctagaagatggagttatcatcagtgaacacggggaagatgaaatggatatggaaagtgagaaggaagaagaaaagccaaaggctggtggagccttttcaaatgctttatcttctttaaatgttctccgtccaggtatgtacttgcagatgttcctcacaaccgaagtgatccctcaggaatgagccatctgtaatgatggtcgttaaggaaggagttagctaagtggtgtttcttccgacatctgtttggagccaggctgtttccttttgcaaatacagaaagaaggagaactagaaagttctcaagttcattctcagacaggtagttttattatcaaaacaaatgaggggttcaggtaaatggataaatagtacaaaagtcctttttttaaaaatgtatttcagattaagattttaactttttcaagaactgctaccaaaagcaaaactgctgctagctttatattcagggtttttttttacattttaatggaaatagtttgcagatctattcactggctaatcagcttttgaataaatacttagtcaccagatttaaattatgaagagtaagcatttaactcattataaaatttaaaaatgcttactctgtgggaacgccttagagctttcactgctgtgaccaaggtttgatcactggtctgaaaacttccacaagccgtgcaacacagccaagaaactgataataatttttttaaaaagtcaaaatgtttgctctgggtttgtaaagttgtgaaaaattacatacatagatctaatagcattctgattggtacagtctttatgggaagctgtttgacattatgaatcaggagatttcagatgtgcttactttttgacctgtaattccatagctataaatgtatctgatggaaataatgtttttattgtagcattaactgcaatgagaaacatttagaaaaaatgtttagtaagagaggaatagtttagtaagttaagttacggtgcatttacatgatgagatatcccatagctacttaaataacaaattagaaaagtagcaaggcgttaatttttactgtaggtaaaagtgttaatttgattatgtagtagattatgctttatctattgaatgttgtaaaccactaaaaattgtttatgcaaagcaacatggaaaagcttatattttaatatgaagaaaaattagacacaggattatatattcaatgtgttttctggtgacctgaaaactatttgcaggtgaaatacactctaaattgaacagtgtgttttaggttgtaagagtgcagatcccttttttgtttttgttctccagtttagtaatcaatatgacttgattacttttgtttagttcttaaaaatgaaaaataaaaaccattaaaataaaactgttttcatgaattttcccctccctgccttcctgtatatattgccattgtatatattttgtttccttagcttctttcagtttctgtttaaactaagttaaaaaaataaatcagtcgtacagcaggcagagtttggggagaggagcggggatgccagcaagggatgttagaacatcatttatgcacggctgtcttggagagattcttttatctttcatagtttcaagaaaatagaacctttcttcctaatatggcatgggttctaatccttactgtttgtttccaggagaaattccagatgcagcttttatacatgcggcaaggaaaaagcgtcagatggcccgggaattgggagatttcactcctcatgatagtgagcctgggaaaggccgccttgttagagaagatgagaacgatgccagcgatgatgaagatgatgatgagaaacgccgcatagttttttctgtgaaagaaaagtcacagagacagaaaattgcagaggaaataggtaactttatttagtgcagtagtaagcctgttgttactaaattttatttgatactacaatcaagtaaaatgtatcacctttatttaaactatgtttaatgttgaagattccctcatagctcagttggcaaagaacttgcctgcaatgcaggagagcctggttcgattcctgggtcaggaagattcccctggggaagggataggccacccactccagtattcttgggcttccctggtggctcagctggtaaaggatccatctgcaatgcaggagacctgagttcagtccctgggttgggacgacgataccttggagaagggaaaggccacccactccagtattctaccctggagaattccatggctcatggggttgcaaagtgtcggagatgactgagcgactttcacttcactttcaatgttggagaactgttcttgcttggatattaagtgtcttactggaatttggggggaagtgtagcatgattttgatagctaatgtttactgaggactgtgtgacgggtattgtgctaagcacccaacatgttataaatagatttaattgtctcttcattctgaggaggcattaggtttcattcttctctttgttgaattgatgtcaaactaacagaggttaggaagcctgtttaaggttttaactgttaaattgatactgcctcttgcttaaggaataactgtgtattaagacaagtaaagcaaaagagtcagatatgagacagatcataacagacactttaattttagtaaagttgagttcatgccaatattcttgcttgattttgtgaaatatcagggtagcatctgttcccttgctgctttttggacttattttctccctgcttatggccataggtatcgaggggagtgatgatgacgctctggtaactggggagcaggatgaagagctcagccgatgggaacaggagcagataaggaaaggaatcaatatcccgcaggtgagagctaaacagctaagcttcaaacctgaaaaagtgaattaagatttctagcctgttttattgaaatgaaaaaacatattgccaaaaaaaaaaagctgtccactgtatagattaaatgtttctttcttgcacaactgtttttttcctgactttaaaaattattttgtagaagatggatttcttagtagtgcaaaaatctttaactgtagatgaaaaatatcttccaaagtagttataacaacttgttctatagaagtaagtagttcaatggaaatgtcatacaaagtttctgttagtgttttgacacaatttaacgtccctactaactcaaaatctcttcattattgttttcctgaaagttattggaaatgaatccagtaatcccataagagaaatttcatccagccctacttttgattttgagaagctctgcaattacttactttaattacatactgtttaaaaaaaatgggtttattattttctgttagttttttgttctttttgtagttttagctactggttttaatatatatcccatttctcatctaggttcaagcaagtcagcccacagaagtgaacatgtactaccagaacacctaccagacaatgccttatggttcatcctatggcattccgtatagttattcagcctatggatcatccgatgccaaatctcaaaaaacagataatacagtccctttcaaaactcccagtaatgagatgactcccgttactattgatttggtaaagaaacagcttaaagacaggtagggcagatcaacttcttaaagacctgtcttctagctttccattccctcaggcaacatgtagtctggggtagcagatacagaatatcggcaaagaagattgactggcctatcttcaaaatctaaccagaagatgacttcatactttgttctgctacctacttggattccttctgtggaagccttgaagttttttttttaaataccactccatgatctggttgaagacaattctcagttttctcctcttggactctgaaaaaagtgtagtcaggatatggggggaaaggcaaaacagtgagattttggttagcccaccaaataactttatataagaagtctgtagactgccattttcttgagcaaaacaggagtacagatgaaaagatctactccaagcatttttatattctaatagcggaacgaaatgcattattataaatattgcaagtgtcctgacagcatagacttccagatgtaaatgtgtgatatttatccttttctgttcttaaggttggactccatgaaagaactgcacaaaacaaaccgacagcagcacgagaaacacctgcaaagccgcgcggactccaccagggccattgagagattagaagggtcttctgggggtattggtgaacggtataaatttttgcaagaaatgcgagggtatgtccaagacttgcttgagtgtttcagtgaaaaggtaagaatgcaaaaatattaatctctttgaataaggcaaaacctagggaggtctagatttctgtatttctcagagaatatccactgactttagctttagaagtgatgaaaagtcatgcttcattttctccacttcattagcagcattctgtcttgggggcaatttagttagtgcctttgttgaaaactaaaaagataaatcaaagcacatttaaagactttggcagatcctgccataacttaatgatggattaccagcctgtcctgggttattagaatataagggactcactgatgaaattttctttcttatggttcagatctaaacttatctttaaactgtttgtataggtaattccaaatatgtatagcataaagttgtaaaattttattagtttttattttttaccctagataaagttgattgccattgctagtactagttttcatctgaataagcctgtgctttatccatttcaaaaaccattcattgaccataatttgttttaaggtctcatttccgagtttttttctttttggtatgatagtcaattggcagttatttgcgttctgttgtaccatttgtttgcattttttgttacctgcacacacaattctctttcaagcaacttttaattgatttttctttaagacagatctattgtttgatgcactggttaaaaaaggcattcgtggacttcacagccttgtctttaaaaagaattaaactcatagtacttttgagtatcctgtctctaaactttcatgggatacaggattagaaggcacattctctcttatccttggccatatgaattagcataggatttgtaggcatatagtatgtttaaatgagtattttaactttttattatctcttgatcagtatcttaaggccaaagactggctaaagaacggtgccaaactgtgtcttcctaatgagtcttagtgattccagccagtctggtcagatccatgaagtcttctctggatgatttgtgttcttgtcctgatcatctgatttctggagaagcagctacattctgggctgtaattgcccgtgtggcaggtctgtggcttagggtgataagtaccagggtgagaaggaaacataagttcgactgtgtgcagaggagctgagttaagcgggaaagtggacagaaatgtcagagctggcggtgtgtcctactgacaaagcccttgtgaacccagggggcatggtggtgggagctggcccagtaagcttttgtgactagagaaaggatctttgtcttaaaccatactttgtaagtaaaatttgtccctgtggagtttttcttggaaatatcttggtctttgctttgcaacttaattgagtaaacttaaacactgtgattgcaaactgagctcttaaaaaatattgacagtaatacgatcaactagattgtaccactcttgagttagagactagtagaatatctagttcatattgttttcagttgcttattatcttgaaaacatttagtagtatgctttctctctcctggttactctgttcctagggaagtatacctcagactatgctgaggtttttacagagtcacttaggtacatgtttttgaagcagatcttaaaccatatctgttatatagtggctacattttaattaaaagagaagtaggtaattcccttttgaagataactttatttcgttttgacatttccatatccatttgattttacggagcctgctgctgagttaataatgtcataaattgtcattctggaaatactgtgtcagggtaagaccataaaaagataagctttcttttgtttttttctctttcattataaaggtttaagtgatttcaagcttagatttttatttttgcagattattttaactttccattgttttgttttcctggagtcgtcttccttcttgtgttctttgccttaaatttggtcttgaaataatggtagtcagtagcagttttgagtttggagagggtaaagaaattgtcacggtgcactcttgtaataaatcataaatcaatattgttaagaaacatgaaagagaggtgaaaatgtgctttaggacttttattctcagaattttctcagggctttgttaaaaggcattttaattacctaaacaaaaattacattatcagaattttaactgtaaattggataattaaggctctgcctgatgcagcctcaggcatctagctcttggcagtaagaagagtgttaatagcctccaggactaaaggagtgcatgcaggcacataggttcattcgtccttagtcctgtatggtttgcaaaaaaatgaggggtgggtgagtgtaagtcacaacaatatggcaataattgcttggaaaatggattatgcttaatcttcaagttagagtctgtgggctcagctgatatcatcaaggtctggggatgctgctgcccatggtgtagcatatgaaagaatgaaataactgcatcagtttgacctttctgtgaacatttgttgcttttgcaatggaatcattcaagtgtatgaaattgcttttattccacctgcttctttttattttccatttgcagtctgttcagttcaggaagctgctataacacttggtgccagtgttgcccaactctaaatagtgtgtttttttattcgcactaaccatcaggaaactagaatttctggtttcctcaggtatgtctagtggttgttagtgttttgtgaaagtttcatagcatttgattatatagcataaggtatttataaaaagagaatgttttctggtttttccttttaagttaggtctcattccataagctttttgtattctgtatgaaccaattgaatgtttagctgtggctgttaacctggaaaaatctgttgactttgtaaagcaacaatttatgcaagcaattttatttaaaaatatggaaaaaattaaatatttgatgggaacagaagaactttctgagtttcaaatagattgatttttagacaggttaatgatagctagaaattttattcactttattaatataaatgaatgcagttcacattttaaatgtgtaataaagccacaaagtagtataacattactgtaaagtacttggtccttgtgaacgatagagcaattgaaatgtccaaaattgggcagttagcaaactctttacctactcagagccgtttttttggtcttacacagcaatattagtttattttaagctacaaaaattgcaaggtagatcatgctgctagaacactaaaaatggattcacgtactttaaaagaaaagcactaaaatttctgacatttctttactcactctctttactattgttaaagtgtttaagtttcctaactaaactcttgctccaacaactaggcactggacattatagttccatatacggaataaaagaagaagtgttacttcccagacgtcgtagaactgaagtactatttgtatttcattggaaattcatgattattctgtccagagggtactccttcagaaatccggaaataatatggaaccctcaaataaataagcatctgaggagtttggtgttacggagtgtgttgtatttttacaggtgccactgattaatgaacttgaatcagcaatacatcagctgtacaaacagcgagcttcccgccttgtccaaagacgacaagatgatattaaagatgaatcttcggagttttcaagccattcaagtcagtccatcttgaaggtttttattattcattaaacaaccttgtttacttagtacatcctaattgaaacgtagacatctcagggcattttttttttttttaaagaaacaaatttccttgctcttatgtcaggtagatctaaaattattaatggcatgtgcttggattgtgtttaagaaaatatagcttcacaaaggagtgcaaatcatgtactaatattctgtcttattcttctttgggcatattttttcattcttcaaagtatagtaaggacatcatcagtattttatcttaaaaccagtatctacttgtccctaagtgatattttttcccccattttaacatcaatacaaacgctaacacaaatgctgttgttgatcataaggttttgagttagggattgggaaattttggatgggagagagggttttattacataacaaatgatacaattgcaagattaggggagttttgagcttcaccccttgcataaagcaaaattttttgtattgaaattttttttttttttcctgttttgccttatataactaggttttttatttttggggttttttttagtaagtcagttgatgccaacacttcttgaaattagagtctaaaaatctggaaattttaaatttatattcctttcattgtgatgtgggttatggaaaaccaaaatgaattagaaacctcttaataagagtttagctgaaactctttaaccagacatattaaaaaacattttaattccactttttcattgccctctatattcttgagtactgtaataggaattttcctatgttggatttctcctggctttttttgtcatctctttggtccctgtgtcagcagttcttaaatggatgtatacatcagaattacccatgatattaatttaaaatgcagatttcttggtcctgtctccagaaattcttgccaggtcttggatcgtgtccagtagtctgcatgttaaacagccactccaggtgttccaagtgcaaagtgccctgttctcattctttctgaaaacaatgctttgtcatatagtgtgtcctctaaattagagagacattgaatccctggaaagcattctcctgtgtgccgagtgggttttggagcatcataaagagacggtgacatggccctcagatgagtcagactcagtgtaagccatgtgaatggctttgaccttctgtttttgccatacacatttaaatttggattagtgccatttggggcacctaaataactaatgcatgcctctcaaatcacttttgatccagacagaaccagatttctggggcagattacaggtaatcattatatctatgatgggaagtaatttccttttaagttaaatggttgtgtgagctgtgcatttcatcaaataccttttcctagctataatctgttctttataatttggaggtatttacttacatgggattcagagtaagggttgaatgatgggtgttaattatcaatagattgacagttggaaagaaatgaaaggtaatgagaaagtgaaaagtattgtcctaaagggagtattcattattgccaaagatttgaggaagattgcatgggatactgaattatcgatttctttttctgatatcttttttttaaagaaacaaaaatacagcctgaaattcttctgtttagatttgcaagtgctttaccacagttactgcatatagttcttacagaaagaaggaagctatcagttgagttgtctgctctgtctctttcaatatatattttaaaaagtctctacatataaacattttaagtattatactaagttaacataattttctttagagtacttctttaatgatggctgcctcttaaagaggcaggaatcatttctgtagtttgagactttttagctaatttatctgtgatatgtagtggagtcccagttgaggtaaagccggggcatcttgtttattaagcagtaaaagagtcaactttttttttaatttatttattttaattagaggctaattacaatattgtattggttttgccatacatcagcatgaatccgccacgggtgtacacagaagaagtaggatctagggtagttaggatacactgaagtagacaccagcgctttttttggttttattttccctgttgctgtgccacgtctttggtatcgggaaaaaacttcagttgatgtctttcatttttcacatcattccgcccccctaccccccacacaccctctggggtttttgcttcccattactatcctgcgtattacaggatgtctccatagtgtcgaacttgaatgtagaaatagagcatcacagagagatgtttcccccatttctgcttctaccctaggcaagagagtctccaggattcttctctggacaaagagagtgggtccagagaaaagaccatgagacactattatctgggggccccaagaaaaggttgacttttacccagtgatctgatggagacgcctctgttagacagctcccacctgcatccacgaaatttccagtctcattcctgtgtagttaatgatcatcggagaccaacacaagcagtaggaccaaagagactgaggacacacatgcaggtggcaggagaaaatttaaaacataattgctgtccttgggagatggcagaagagaccctacatgtagcacaagtagaagacgctataaaaaagaaatattctaagaagaatagccataccttggaaactaaaaaatggtaactgatatataaatataaataggaatgtcgaaagctaagttagaaaatttgtcttagaaattaaaaagagagagagatggaaaaagggaaaaaaagaaataagggaattgtgctttgaaagtagcggttgagaaagcacaacttggtcctatacagataggatttttagtctatattgttgattctgcccttgttttttaaaatagtaatagagaataaatttctgcaaagaaaaattagaacaaaatagaataaatcattaaattactacaacaaagatgttttttcatacttcctacttagcaatcactctttgctgtcatttcatatcattcaacaatatgatgcttaagttcattcctaaaaaagtaatgtattatttttccctttacacaaataacttaggtttttaacttactttgtcatcatgatagcataaactggttttgttacttagacataagaacagggattcagccagtttgcattggggtagtgttgtcagactctctatttctctgctcctttttgtggaaacatggattaatattgagatttgctctaaattagcaaactatctggtttatcagttattgcagaatcccactgttgagattagaaagcagtctgtcattatggcttattctgtgcaaactctttcctcaagattgttggaggaaggcttttaattttaaccattgttgttttccagataaagctctgatggcaccaaatcttgactcctttggacgagatcgggcactgtatcaagaacatgccaaacgtcggattgcagaacgggaggccaggaggtaatctccagatgcttgctgttggtcggattgtgaagggaggagtctcctttacctggtttggaaactcactgcttgttatttaggactcgtcgtagacaagccagagagcagactggtaagatggcagatcaccttgaaggcctttccagtgatgatgaagaaacttctacggatatcacaaatttcaatctggaaaaaggttagacttttatttggaagtgaaattcattgtcattgtgctttctgcttggctgtagttgttaccctgaaataatgtgaggttttgtggcctttgctttagaacttggcacttgttgcttgcttgcacctgtttttacctgtttttattactgaatagcgtgatgaattctcgcaattagtggtaacactttgttgtggggtttacttagttacttgcattataaataatattactcttcagaatcgtagaattttaaaagtgacaggagaatgtttcagatcccaagggccaccctaatgcagcctgtctggtctagaaaggtaaaggttggcagtagggagcccttctcagccccaaagggagttcctgatttggggagtcctgaatcattcaaccacggggaatagttcgcactgttacatgaaggcgtttccagaaggaaccccaagtaaaagtctttatttcccaccattggctgcagttatctgtcatttattaactttggaacatagttggagaagcttattttgtttctcccgcttttttatagtgaacatttctaaacatacaggaaattggaaagaatagcacagtgatcactgtctacctgtcacccaaatccagcagttctttccatcagttggccaagtttgtttcggatatgtgtgtttcgctgaaccatttgaagttaacttacagacatcatggcacttgcctctaaaaactttaacatatttaatgtctcccccctgaaaaaggatgcttttctaccttattgtaacactattaccacccttgagaaaaattaactgaaacttcttagtatcatatctgtattcagtacttcccaaattctcaggactgtttttgtggggtgctctgtgttttccaaacctggatccacacaaggcttctgcattgcacttgatcattgcacctttttaatctagaattaatgaatatcatgagtaccttataatacacacactcctactatttgttcaaggcatttgctttctgaaggccatttgtcttataaaatgtcctacattctaaatttgtttccccgtggtattaacttgttcctccagtcactgtatttcttgtaaactggaatttaagtctggagtcttaattagattcaggttaaacctttttggtgagaatacttcatacaagatgctctttcttaatatataatagtagatggcaaatgttaggctgccttctatcagtagtgtttaggtggatcttaagaagtagattgtcatgactaggtctcttcattataaagagtccactgttcagagtcatatagagcatcaaataacttcactcaaagatcctagcatccattgcagattcttatctgttagttattgtagtcaccaagcaactttggaagaacagatatgattggttattgatgatcacgcacatctgttatttaaatggtgatctgtgggctgaagagctggatacagagtttgtattttatgcaattactcacacttactgttccatggtaactgaaatttgaactgagttttggggaacgggtgttatttagactatggtagcagataatggtacatattagaactatgcagaatggcacctgcctgcactgtagtttgtgtgatagacatttggaggctaagtttatctctgtttcctttcctttaagtttcagttgataattcatttcagtcgctcagtcttgtccaactttttgtgaccccatggaccgttcctttgttaatgagcctatcttattacttactcaggctacagagaaaatgctgaaaataattgaactgcgttttttctactgcatactaagttaacatttctctgtggggtttctttgtttttgttggttttagatcgcatttcaaaagagtctagcaaagtttttgaagatgtccttgaaagtttctattcaatcgattgtattaaatcccagtttgaagcctggcgttcaaaatactacacatcctataagcatgcctacatcggcctttgtttgccaaagctgctcaaccccctcataaggctgcagcttctcacctggactccgcttgaggtgagtgtcttctctcactgttggaaagcaggataccatgatgcttggggaagagatgaagcttgaataaagtatttttcccaggaggtacctcatgctcagggctataagtgatacagagtatcactgggtgtaatcttaccaatctttccttttatgttctgtccctttttaagagcaccatctattgcttctcaatttgtatacagtatctttctcaactaaaattacaagtgttgacatggaaataggaacatgaatgaataagaacttggtcctttgatcccagaaaactgtagaacgtcatgggaaagctcagtgaagaagatgtgaagtggggccctaaactaagtcagtagtgatggaaatcaggaggatgagatttaagaggtgcaatcagtagaaactgtttgcctgttacctaagggaggtaattgtctaggtaattgttgaattgtctatgtacatctagtggtcatgttttagataacagttttgtaagttaccaacatacgggtggagccgtgggcaggaatgagatgggctgggttgagcatgtaaactataccaaaaagaaggctgaggtggaagccctggaaacaacaggagaaaaacatgagctctggggactcttgggctcctggctcctgcttgcccagcccccgtggcgctgcgcgctatgctgtgtgtcccagtgcacagcagaggctcacggcgcagtggtgcgcccctgcaagctctccatcttcacagctcctccctctgtcccgcagccgccagctgtctcagcctccctgagctgcctttctggctcctgactcagcagcactgctctgcttgggggttccctaccctgctctgctctcctgaccaggagtcacgtccttcgactgccttctttcagggcccatagccctatgctgcctctgctggtccattgtctaagaatagatgtttcctatattttgtcacatatttagtttatggctgaaggctgaatccagttccagttactctctttgtggctagaagcagaactagccactgttttaaatgtttgggtaaccttttaaatattttctaggcaaaatgtcgtgactttgagaacatgctgtggtttgaatctttgctgttttatggttgtgaagagcgagagcaagaaaaggacgatgtcgatgtcgcactgttgcctaccattgttgaaaaggtgattcttcctaaactaacaggtatagattacggaattgaacattcacacgcattgggtttttcatatctattgttaggagtttttaatcagagcatatattctcatagaaattacattattaataatgaagttacagtcagacccagagatggctaaagggtacctgtctcttaccttgggactttgaagaccaccttggggagggcctggaattgggggcagtagggagattttagactcttaaggactgcctgaagcaaaactgaatacatagttttgggaacaatatgcatttttccagggagcagtttcatttctttcatcaatttctcacaaaagtttagaaatcattgacctagggagctgtttaaaatatgaaaaaagtttaggttcagttagagattcttgacactgggacagaatctcctgggatataaaaatccccaatctttattttcaccaagaagcagaaaataataggaatctgtgtctcctcttcacctttgcctaattgtcaacatttctgtggttaattggacaaagacaactgaagctcatgctctagaggaagagtcacgattggcatttctaaacggagaactgcttgacatcagagttacatcagctgcagtttacgtctatatctcagtaccttctacctttttttttccttaatagtgattgctgaaaatatgtgggaccccttttctacaacacagacttcaagaatggttggaattactctaaaattaataaatggatatccttcagtggtgaatgcagaaaataaaaatacacaggtaatttagttattatttatgaaaagtttaaaaatttttatgtatcttctctccctttgaaaacgagcaagttgagaaaacgagtgggttatagtcagaaaatctgattctcccacttgaggtatctggtcctttatatagaaaatctgagatagtggtttttaattttaaaagagtctagatagcttcttatctatactgttttcatccttctcaccaccccatcccctttcacaatcagacatcccttaaagaacttaattttgggggagggaaagaaaagcagaaaagtactgggatgtgtaccaattgataatttaaatcccgaaacatgtaatagcatgtaaaacaatcaggtgttgttattgcataattagtttccaaactttaaattgctgctgcccccactgaactttcttacaagcaatatagacataggaaagtactctttatcattgttttactttctgacctcattttgagaagaaccagacttacaggtctgattttaaacctttatatagtagattaaggggctggaagatttctaaatgactttattacttggtaattgatgaggcgtgaactaagaagaaagacctttggtgagaaagtaaatttgagctgttcactcaaaattgaatactcaattaggtgctttggaatgtggcttagttttatttcctaaacttttaccataacccttattataatgcatgatctatttttaactcttcaggtatacctaaaagcacttctattgagaatgaggagaactttagatgatgatgtattcatgcccttgtatcccaaaaagtaagttattcctaaaaatgttaaagatgataatattctctattgtttttcagagaaagcttcttaaattttgggaaaactaagcgtagcttgtaatgtaaacttcacctaagtagtctaaacgtgtagcccagattgaggagctcattgtggaaaccgcttcccttaagcagaataaaacaaacagcgctccgttatctcagaatacatagccattaccttttaaaattactgtcttctggaatacaattgaaaatcagaaaaattcattgcttcctttgttcacctcttacttaacagaaatcttctagaaataagatggaacttaacgcacaacttttgatcatgatgtgtttctctttttttccttagtgtcttggaaaataaaaattctgggccttacttgttttttcaacgacagttttggtcttcagttaaggtaagtgtctacaagctatctgaaagctttggattttgtttgactttcatacagtatatttccaaaaagtattttaatatttggttaagtaacttcataggtttgatgtttccagaggagaaaatgaattctgagtcccaataaggtccagactacccaacaaaatgccttactaaaccacagttgatttattcagcaaatagagtaccaggtactcttctaagttgggggaatatagcactgaataagatagaagtagagccatcatggtgtttataacctagcacaattgactagagcaaataagtaacctcaggtaggaggagttttgaaaaaagaaattcagagttgtattggagcatatgacaaggggcatagaagattcccatccatcctgagaagtgatatttaggttgttagttggccctgaggtgagggagagaaagatatactagaactgagagaagtccagggtggctagagttagggaagagataagcaatccagatgatacagaagctataatttacgtggaaacattataggagactcctctaatcaagattataacccaaatcccccaattcctaagacctttttattgtcttatagttttctttgtaagaatgtcttaggaatggaattatatactagttagccttttgaatctgggtgcattcatgtaacataatgcattcatgatttagtgttattttatgttcattcctgtcttcaaatggtgaatatagcatttaaaaattttttattgaaatatagttgacttgacagtgttgtatagtagagtgattcagttatactgaatcatatcctttctcagattcttctggatataccattttttggtgcatttttttatccattagatagtttacagtttggagtaattatgaataaacctgtcagcatacaggtttttctgggtatataagtttttatttctgtttgataaatatctagattattaggtaaatatctgaaagctgttttctaaaccaacagtattagtgttctatttctttctcacacacctcagtatctttcagggtttttattttttaagccattctccaagtgtatgttcaggtcttgttaaggtttgtgtttccctaatgactgatgatgctgagcatgttttcatgtgcttacttaccatctgtatgtggctcagatggtaaagaaactggctgcagtgcaggagatccaggtttgatccctgggtcaggaagatcctctggagaagggcatagcaacccactccagtattcttgcctggaatactccaaggacagaggagcctggtgggtgacaacccatggggttgcaaagagttggacacaactgagcaactaacactcatgttctttagtgaagtatctttgcaaatctttggcccatttttaaaaattgggttttcttactattgagctttgagttttgtattcttgatacaaatacttcacatacatgatttgcaaactttttcccctgagtctgtagcttgtcttcattctctcagaagttcttcattctgatgaagtccagttactactttatcctgttatggattgtgctttacatgtcacatctgaaaaatctttgtgtaacacaaggccactaagtttttctctagcctttcttctagatatttcatggctaagctctacatttaagtccgtgatccattttgagttaatctttatatatggcatgaggcctggttgttcaggttcatttgccccagcacactttgttgaaaagatgatcttttattaaattcatttgcttttgaaaatcatctgcccttatatgggtcgtggaagggtttttaagtagggaggtgacttgcaaaatattgccattttttagatattgcagttgctgtgtggagataatggtttgaagtaggtaaagatggtaataatgaaaatgggaattagtacttaccacatatttactgtgttccaagcgctgtaccacactctttattcagattatattctctcgaatcctcacaacagtcctgtgagcttaactccactgatgggacagtggggtgcggaatcacctacccaggcttactcctttgttaactggtagagatgggagtctccttcaggccagtctgactcttcagcagttattctcaactgcggttctgggaacaaacacttaggtcctggtgccctcaggcctctatcgtgtatgtatctggaatggtattagtttgtcccatccttgggaaaactaaagagttacgcagatcattttctgtaggattgagttctgtcacagaccctgcttgagaagagctgtccctgagccataaagagatgacggcagcctccgttaggggcatggcagcggggaccgagagaagggacagcaggggtgggggcggggtgagacagcttgagggagaggctgggagtgacatgtcggctgtggcctgcttgatttgttggataatgttgtatttcctaggatgagagatactgagaacatagaagtatttatggtagaatgcgtggggacttttgggtattgagcttaagtagcttccagtgtcctggttcatgaggtctggtaaacatgcaagtcttacaggttagtctctcagtggtgtctgattctgcgaccccatggactgtaccctgccaggctcctctgtccatgggattttccaggcaagaatactggagtgggtttccatttccttctccaggggattttcctaatccagggattgaacccaagtctcccgcattacaggtggattctttgccaatgagccaccagggaagcatgcaatatggtagtcggaaagaaaatttccatcttttggcatagtcataggactatgacgtttttcatgattttcaagggcggacatttatctaagaataatcacttctctgccagtacttgttatgatggaaactgttcttacctgcattgtccactacagtaactactaactctgtgtggctatttaaagtttagtacatctcagtcattctaggaaatattcaggcccttcaaaactgcttcttagtgcttgggcaagacatggtccatggtatttcataaggtgttttagtgtgtaagtaatttactttgtatgtacttaatttaatcgctttacattgcctctcagtacttttcttcccttctcaaaaaaacaaacttgtagtaacagagatctgatttgtggttgcaacaggtggggttcagttcatttcatttagtcgagtccgactctttgcgaccccatggactgcagcacaccaggcctccctgtccatcaccaactcctggagtttaactcaaactcatgtccattgagtcggtgatgccattcaaccatcttatctctgttgtccccttcttctgccgtcaatctttcccagcatcagggtcttttccaatgagtcagctgtttgcatcaggtggccaaagtattggagcttcagcatcagttcctccactgaatattcaggactgatttcctttaggatggactggttggatctccttgcagtccaagggattctcaagagtcttcttcaacaccacagttcaaaagcatcaattctttggtgctcagctttctttttagtccaactctcacatccatacatgactgctggaaaaaccatagccttgactagatgggcctttgttggcaaagtaatgtctttgctttttaatatgctgtctaaatggggagatggggtaaagtaatcaaaagatacaaacatccaggatgtaaagttcaacatgatgactgtaattaactatagtgtactgtgtatttgaaaattgctaagagaatagaaaaaagatgtgtaactctgtgaagagagggatgttaactaaacttgtggtaatcatttcacaatatatattttaactatcactatatgtttaaattgttaaacttgtgcaatgttacatgtcaattatatctcactggaactgggaaaaataatttttctcttctttctagctcttagggaattttcttcaatggtatggcattttctcaaacaaaactcttcaggaattatcaatagacggtttattaaatagatacattctcatggcttttcagaattcagaatatggagatgacagcatcaaaaaagcccaaaatgtgagttaaatgacacatattgtagtttttaaagcatatacgttaagatgaattgttttgtttgaagagatttgaggaatttatgaaaacccctttgattattgaatttgctgtaatgttgacagtcagcttgccgcccaggtggtcccaaatccccttagcattttttatgtaaaaatttgtgctgttgtatgtctatgtttatccttctatccatctatctatatcaatatttatttttgtaggtactaataaaagttttaacttggagatagttttataacagttgaatgaatactattctaagtgttactaaagaaatggtttcttttctcatttaagaagtaattttagttaattttgttttactatacatgagtttactttatatgcatgtgttatatacacaattttgatagttttttaatttttaaacaataatacaattaaattctgcaagtacagtatagctttttgacctgtaccatgtcagagtaattctctgacttactccctcaccatcaaatatttttgtgtcttgtttcctgtaaacatagattttgttgtatattacagtataaacatcaacattaggaaattacatttatatattgtcacctaattcttagggctcttttcaagttttatcagctgtctcaataatatccaaagaaattggcaaaagaaatttccagatcatcctttgcattcagttgtcatttgaaggtttccttgaccttcatacgttgatacccctgaaaatgataggccagttttttgtagaatgtccttcagtttgggtttttctgatattctctcatggctatattcacattttgcatctttggcaagaattgtactagacttgattagtaggggctccttcaggttgacctctgtgaccttgtttctaatttgggggagcatttctttgtttcctggcacgatgttccaggcacacctggtacttgcttggcccagttcgaatccgttgtttctgcaagcatccccaggttcttcggtggggcgccttgtctgcccactggccgctttctcgcaagtgggaacaggcttccccttgctcaggtttcggttccccatgccgagttgctgccatgccgtgctggccctgcttaggtgcctgccctaggctgcccctctggcatgatgctctctccaccctgtgctgggctggtgtggctcccgctgtcggcatggatgcctgctgactgaacggttctgcgggggaggggctgcgatttggtgtttatgctatacatattattacatcaaaaactgctgacaaaaggtcagctcaattcatgtagggcttggaagactggaaagtgaggcagttagttatcaattttatgtccccaatgtacttaaattttggagaaattatcttttactttgggtgtctgtcaaagtttaaaattagagtatatccaagtatatttgtatagcttatgtagaaaatctggtttaaaagaatatcccttctaagtgattagttaatacatagctcaatagcatatcttccagttaaatacattatacctgttgtctagacttggcttttagacactttatttttgttttaactgttctacatctttcttttccataggtaattaattgtttccccaagcagtggttcgtgaatcttaaaggagaaagaactatttctcagttagaaaacttctgtcgataccttgtacacttagcagatacaatttacagaaacagtattgggtgctctgatgtggaaaaaagaaatgcaaggtaattatttataattactgaatgaaacagtgatctagagtcttagttgttggtctagtattattaaaatgcttttggtagagacatgtttatattttactttaaattgtacattgacttcatattgataaacctgccaaaaatgtgcattgtatttttcacttttgcaactcttacttaatcttttttcagtatgttatttattcatgaaaatattaagggaagacttacttctagtaagcaccagctgtaaggggaatgaatgaatcattattttctctgccttcccccatgaaaaattgaggagactgtagactcttagaatgtcatgcatcttggtctttcgaggttcattttacagatataaacccaagaaaaaatagccactgaaaccccaagtatattgaaggttatatcccaatttggggatgtttgtgttctatgttaagttttatatcattttggtgttggttgcagtgttttggggagtttaaatataaacaaacagtattcacttttctacagaaaagaatttagcaactatttaaatacctgctgtgtgcagtgcacataaagtaggctccatgtgggtcacaacatcttacaaattataatccttcccagaaaggtgcttactacagttctatagagaagagacaactgacaatgtcacactgactcaaactaatgttaaacgtacttcctggaccagcagcagcagcatcacctgggagctttgttagagacacagattctcaggcctcaccccagacctgctgaacagaattccgagggaggggcctggtggtctgtgtttcagcactcctctagctaattctgatgtatgctaaaatttgaggattgctgagaatgacttgtagctaggtgataaaggaagccagattatactttattattggattttagagaaatggaagttatgctggatcttgatagattggtgatgaatactcacaaatacaatttgtgttcctggtatattctggaagagctaggacttgggtttggaaggaatgggtggctggcctctgaagtagttaggcaatagattgctttcgttcctttctagatataaatgaaaatcatggatctgaacaagatgtggggtgttttgttttttttaaatgagtcctttttctggctactcatctaaacaggaaagttttttcttttttaatatggttaatttttttcacatgctataacttgcttatctctgtttccttttttcttttttagagaaaacataaaacagatagtaaaactccttgcaagtgttcgagctctggatcatgctatgtctgttgcaagtgaccacaatgtgaaagaatttaagtctttgatcgaaggaaaatagatctttgagactaaaaaaaagcctatttgctctaataccattcccagtgtaaaaaatttgtatatatgtaaagtttcttaaactgtaaaatattgactgattttaatacaaagaatgttattaatattcaatactgtgtccttaaatgcagtttcttcacaatgaaaggaattcaatttctaggaagtctatgaatggtttccttactgcctgccatactttgtttacagaagtattttatatggtcaattaaattaaccctctcagttaattgttctctgtaaaggatgggtgcagtgtatattgtatagttatgcatatgtatatttataccaccatggagttactttcacactggaaatttgtggtgtttttctacagagcaagccttttaacagcagaaaaattagtcagtagcaaattgtcttagggaaattactacactgttgcaacaaaagggctggcaagtgactattcatcacttttggttagcagttgctgtcactgaagctgtgctgccttaaaattgagagttgagtgtggacttagtcattggtgaatggtgaacttttcttccttgagttagcattacagtcaactgttcgtttaatgtgagctctaaataatatatgcaacataggtttctgaagagaacacagacatttcatttctggaaataatagacccacaacctaactgcatggttttgggctgactgtcctgtctcattcatgattttactccctgaccagcttaaatacatgcatttgtattttagtagtctagcattatatttaaaatcccacatatgtgagttatatatgcaataaagaacacattttgctgattccccacacccaggcagtttaatatccatggtcttctataatatttatgtactgtgcttagttggtcagtcgtgtctgactctttgagaccccatggactgtagcctaccaggctcctctgtccttggggcttctctaggcaaaaatactggagtgaattgccatgccctcctccaggggatcttcccaacccagggatcaaacccaggtctcccacattgcaggcagattctttactgactgaaccaccagggaagccctataatatttataccatgttgtaaatgattctgtgattttcaaaagaggaactttttggaaattaagaactactgttggatagttacatatgtaattaggctttagccaagcattaaattaatttttaaatagaaccattgttgtatttggctggtgactaattttagttagagcatttcaaatgactaatatagtgagatcattagcatgagtagccttggtcaagtcaaatactatttagaacagtgtcatgcactctttattgctcttgtcaattttatctttattgtaggaacactgcgtatccctacagattcattctcaataaattttgttacaactcagtggcctactaaatagaactaaaatagaaggcttattctcaacttcagtgtactaaaatatataaacatgtatatatgtatatgacatgcacatcatttgtgccttaaatttgtttttcgaaacctattggactgattacttttcctatatctgcttttaaggactcgaagttaaactcagattcttcatcctataaaatccatcaggctcttatactttcaggaatgagtttggtataaggtgaatttagcatagaactgtgcgttaaacaagtagttctcatatctcaaccagaagttttttattcctgaaataggtaaaggacattctttcttaggaaggaaattgtcaaatgtttaaaagagggtgacattttaataaagcttgaggtttttgtcttttcagttttttcttttggcgcagtcttccaaaatacttgcaaaatagatgaggagggttttcgaaaaggaaagttattgagatactataaaccacagtcataaagaccgataactactgttgtgtaccagatgatgctggtgagccacatccttattgatgtcatggtgcaaacacctgcagctctgccggaggcctttctcagcctgtgctacaggctagagggtccaccacctctgggagcaacccttggccaaagaaaggagggggagggtaagtcccccagtgtgttagttcaggtcctctggggagcagtccctgagatggcattggatatacaagagatttggggggtggaaatgatgatgggaatgaaggagaagggagcgggaggaggctgagagagctttagagccaagagattgtgagcaagtgtgacctctgagggtgagtgggaaggaattaaggaaggtgtcagacatcagtggagtcctcaggaagtttgagcaaggctgacggattcctcagtacaaagtcatggtcctgaggagttttgtgtttccaggagctggcctgcctttgtgtctctaccagctcagtaaggggtagaggacagttcttgaggagcacagccactctttggagatgtaaaggagcatgctttcacgttgaacataccagcttcctagtttcaggaaaacaggtatgatccgtgtcatctctcacaaggctgcagttgacttgaaccagagttgtctgcagtgatgacctcatcacccagaactggcccagaattttcaggaatcttaagtgacttcctcatgagaatatactaaaatacagagttccctggttgttttaaagataggtttgtggggtacgatttattataaatgttttaccctctataaacacatatagttcagggcatttggacaaatgcctaattttgttttaaatgagaatttcccttgaaattatgacatcctcctaaaaatagtcatatgttttagagctgcaagatacaatatgaaaatgtcagttgctacattgtgtttttttatggttacaatgactcttctcatttctaacactaaaatatccatgtagtaaagggagtgttgccattccttgattatgacaaagaacactttgttgtttcaagtaaatgaaaataagaactgtctctgggcattgggttcatagtttctaagagactgcagattgctcagcaaaggcagacaggctaaaaattgttacgtggaatcagtattgatacacaatgttgactggtcactggcctgcttctggacctctgagccccagttattgtactggcttcctcccaaccccatcacccctaactctcacagaggctcagaggttagactcatccagtacgaggaaaatgcctagcaaagcgtttctcagaatgtatactgtggttcaccagttcaggggctgttactttaaacgatgtttaggaaaatgagacctaaatataagatatgacaccataaaattcctagaagggaatgtaggcaaaacatcttctaccacaattcataccagtggtttcttaggtcagtctcccaaggtaatagaaataaaagcaaaaataaatgggacctaatcaaatttacaagtttttatacagcaaagggggagaaggcaatggcaccccactccagtactgttgcctggaaaatcccatggatggaggagcctggtaggctgtggtccatggggtcgctaagagtcggacacaactgagagacttcactttcactttcatacagcaaaggaaaccataaaagaaaaagacacctacaaattgggatatttgcaaatgatatgactgacaagggcttaatttccaaaatacgtaaacaaaaacccaatcaaaaaatgggcaaaaggcctaaatagacattcctccaaagaagacatgcagatggccaacaggcacatgaatagatgcttaatgtcactattagagaaatgcaaataaaaactacagtgaggtaccaattcacactggtcagaatggccatcattttaaaaatctacacgtaacatgctggagaaagtgtggaagaaagggaacccttctacactgttggtgggaatgcaaattggtgcagcactgtggagaacagtatggagtttccttaaaaaactaaaaagagagttgtcatttgatccagcaatcccattcctgggcacatagggacaaaactgaaattcaaaaagatatgcaccccaatattcatagcagtgaagtcagaaagtcccttggactgcaaggagatcaaactagtcaatcctaaaggaaatcaaccctgaatattcattggaagaactgatgctgaagctgaagttctaatactttggccacctgatgtgaagagcagactctttggaaaagaccttgatgctgggaaaaattgaaggcaaatggagaagagggcaacagaggatgagatggttgcatggcattactgactcagtggacttaagtttgagcaaactctaggagatagtgaaggacagcctggtgtgctgtagttcatagagtcagacatgacttagtgactgaacaacaacaaagtcagaaagaaagacaaatactgaccaaatgatatcacttatacgtggaatctgaaatatggcacaaatgaacttagctatgaaacagaaacagagtcacagagaacagacctgtggtcccatggtttggtggggttgggttgagagtttaggattagcagttgtaaaaatccattctttataatggataaagaacaaggtcctgctatatatattggcttcccaggtgacactagtggtaaagaccctgcctgccaatgcaggagacttagagagatgtggattcaattcctgggtcaggaaagctcccctgcagtagggcatggcaacccactccagtactcatgcctggagaatccatcccatggactcgctcagcctggtgagctacatatagtccatggggttgcaaagagttggacatgactgaagcaacttaacacacagaatggataaagaaaaggtcctactatatagcactgctgctgctaagtcgctttagtcgtgtccgactccgtgcgaccccatagacggcagcccaccaggctcccccatccctgggattctccaggcaagaacactagagtgggttgccatttccttctccaatgcatgaaagtgaaaagtgaaagtgaagtcgctcagtcgtgtccgactcttagcgaccccgtggactgcagcctaccaggctcctctgtccatgggattttccaggcaagactactggagtggggtgccattgccttctccgactatatagcacaggaaactattaatatattcaatatgatatgataaaccataatggaaaaaatatgtaaaaaatgtacatataactgaatcactttgctgtacagcagaaattaatacaacattgtagatcaacttaataaagtaaattttaaaaagatatttaggaaaatgtaccttattccccatgcttgataattcaaaatacatgataaaggataaaagatttgacaaatcctgtagaaaccattttaagctacttcacaaaagcagtttgaccatgaaagcttaccttttacctgtacctttagatgttgaaattccacagtgcttgctgtgtagggaccaagagccagactgaacaatgaacatcctaccactctgatcttgggaaggccaagtcctgttatggctctggtcctttgatttccacaagaatccttgtatatcattaacacaaaccactgagctcccttgtgtgggtctcttttttacgaatgaaaacaagtgtcacaagttgcctgtttgtcacatacaagttccctgtatgctccagttgcaatatccttaactctggtatgtgtgaacagtttttcagtctttgatgtttttgattttattctcaatgattctgctctcaaacttatatatttttaactgacaaaatttctgtttttccaatttaaaatcttatccttcactgattactatgaacttgttcaaagcaaatagctaatgctatttgtaacttaccattgtgttgctcttcaagaccgttgttttctcttttacaaggagtcatccatgcctttctaatggatctttgcagatcttgatatgaagatctgtatctgtctctgtaacctgaaagaagctattaaagataacagaatcgggttgttaacattccgcaaatttaccaaatgctttctagcatttttgataaggaaatccaggaaaagtaggctactattaatatacgtggtagatatgtcaaaattaatagcttgtagcatatggtatattttttatgttattggggtaatcaatcatttctaaagaaacaacaaatgtatatttcaacctgatatagggaattgtccatgggagaataatttggtcaaaacccaacatttaaaaatcacgttgggttttttttttttttttttttggcatgtgggatcttagtgccctgacaagggatggaacccatgccccctgcactggaaatgcagattcttaaccactggaccaccagggaaatccctaaaaatcatagtgtttgccttcaattcatcgaagctatgggagctgtcttaaacatctattgggttgttttactgatctcagtttctctcctgatggaaagttacattgtcttatatagctgtctgtggctgctgtaacaaattaccacaaacagtgtagtttaaaacagcagaaattcatttcctcacagttctggcatccagaggcttgaaatgaagatatttgcagaaccgtgctcccttctaagactccagggaagaatcttccctgccttctggtggccgctgacatcccttggctagtggccacattgctgtagttgctacctctgtcttcatactgtctctgtgtgtgtaagtgtgtgcatgtatgtgtgtaaagtctccctctgctgtcttataaggacatttgtgattgcacttagggaatacccagataatccaaagtaacttcaaaatccttaacacaaacatatctacagagacttgttttccccataaattaatattcacatgttctgggggatgtggatatctttaggaggtagtatttttcattcaaccacaggcctcgctgttcattttcaagggtcaagattttgtcagcccatctccctaggcccttaggacttcactgagaagtttgtatatgccatttaacctgtattttaaagtcagcccattccaaacttcaaatttggtgacaatttggccagctactttcaagtgttgtaatatagaagtacaaataaaagacaagataaacaaggagtgacggttttaaaaagtcactgataaaatggcacttatgtttttaaagaatctgcctgcaatgtaggcagacctgggttccatccctgggttgggaagatctggagaatggctacccactccagtattcttgcctggagaattctatggacagaccgtgaagttgcagagtcagacatgactgagcgactaacataagtatgtttttaaaccctgagcatgtgcttatttcatgactacaatgatctgttttgaaaggatttggtaaagctgtggccttctgacaactcttgaaaaagagtccagtctaatttaaagaaaaaagcagcaaatcagacccagaaccaagaaatgttgacctaaatgtccttagttgaaatccaaaggaatcaggaataggcagatcattgaaaagaacctagcactgatatggagtgggcaagtttggttggtggtcccagccctacttcaaagtgagtaatttttttgtttgttcttttaattttttaaaaaaattttatcatcacactgagtaatttttaacaagttaacttttctgggtctcagctgtcataaagaaaaagaacaacttgccagcatcatactcaactacatcaacacatttcctgaaggcataaccttccataagtttttctggtgcctatctatctgctattcctttggggctatacaagtaatatacctgctgctgctgctaagtcgcttcagtcatgtctgactctgtgcgaccccatagacagcagcccaccaggctcccccgtccctgggattctccaggcaagaacactggagtgggttgccatttccttctccagtgcataaaagtgaaaagtgaaagtgaagtcactcagtcatgtctgactcttagcagccccatggattgcagcctaccaggctcctccatccaagggattttccaggcaagagtactggagtggggtgccattaccttctctgagtaatatacctagaaaggcaaaaaagaaaaaagtccactctcactcactcctatttcatttttctctgtccagtgcaacctccaatcgaaatggattcttctggttacttccccggtggttcagtggttaaaactggctgcggttttaacagccacattcagttcactccctgatctcagggaactaagatcctgcatgccacagggtgtggccataaaagaaatagattcttctggagagggaaaaaaaagcaaccatggaccagtagagtgtcttaatgagtttagttctgaggctactgttagaaagcactgctgctgctgctgctgctgctgctgctaagtcgcttcagtcgtgtccgactctgtatgaccccatagacagcagcccaccaggctccctcttccctgggattctccaggcaagaacactggagtgggttgccatttccttctccaatgcatgacagtgaaaagtgaaagggaagtcgctcagtcgtgtccgactcttagtgaccccatggactgcagcctaccaggctcctccgtccatgggattttccaggcaagagtactggagtggggtgccattgccttctccagttagaaagcactacaaagagcaaaaacagtttttctaaggagatggtactaaatgagagaaatcccctccggtcctcaaactaaacccaagtgtctttgcatatttccttccataaaagaagtggtttctttgcttatgatttatagctactttggtatcctgaaacctggatggtttcagcttctttaaaatggatgaaaaaatgttaagtcacatgacagggcctggaggagaaagtgatcttgtgcaatacactaaatttaaattctgcttttgttgttaataaaaacaagaagaggaaggggcaaagaaagaggaaagcaagaggaaatgatttcccgaggtgcggagttcttttgagtttattccaattccttttgaccctgtgggttttgacttcattcccaagtttaggtctattaagtggaaatggactgagaagtccatagggcaaactgatgttatccaggaagcatgctttgttgaaaaatgaggatagggtgaaatgataagatgccctgagctgtgaaattacacggttggcgagagctattcgccatcgggtgacgacccagagctactgcctgggcctcagtacggccgtgtggaagtctcgagatcctggcttgtgatttcagacagcagacaactcttttacggtgctcctgagagctccagaacacacaagaaaactgcagcaaacagctgttccaaagcgggcaaccagctcttctcctgctacctacccagacgccgtgagacaccatggacagctcttcaggcgctgcccgcttggccggcgtgctgccgtccccaggcctaaccccgagcccgttaggccggtgcgggaggcggggggtggtcctgacaccctattggggcaagcccccgaagtttttcctcagagtccctccccggcaccccaggggagggtcggtaagctctgaggagaccaagcgagggcaggcgggggaagccgcatcctcgctctcccggcatcctcagcggtgggacctgcagccgccgcctggggaaacacgccgcccgaagcgaaggtcgctgcgcgcggaggcggcgggcagctcacggttaagcgacccgcgggggcagtcagggagtggggcgggacctcccacgacaccccgccccttccccgctaagggggcgggccttccgcccctcggccgcggcgcaatgcggaagagatggacgcgccggagcggaagtgacggttgcggcggcggcggccgcggaaggaggaggaggagccggaggaagaggtgagacagccggcctgtgggggggcggggagcggctgcggccagacccacccgctgcggggctcgcgggccggcgcttcccggagcagtctccgcctccgcagcccgggcggcagcggtgagcggccaccgccggcagcccgggtacgggagggcaggcaggcagggtgggtgggggaccgccgggtttatgcggggcgccgcgccgggcggagggatgactgaggtgacagcggctgtcagcgcgcctgcccgcgggaaaggcagcgagtccgtctgagcgccgggtcgtctcttctggcgtttaatggagggatggggctgctcaggcgcttgcgtcctggcctgagaaggagccgctttccgggctgtcgacggcccgggaccccccgaggagccccggtccagtcccgagtcgtcactcttctccccaccccgggtggccattgatatttaccggcccccggacccgtcagcggcggtgccccgggcttgggcttgtgcggcttctcttcaccgccgctccccgccccgggagctcctgtggtgtcggataatcctttcccttctctcactcctaaggagctttgaatcagccctgttcaccttccttcccaccttcgtctcctcccccgcgccccccagcccaggggatcggtttgaagtttccgaatcgttttccctttcaaacggcagtgagaaatcccgaagcagaaagctgataaaccactcccgagcgaaaatagactcatttttttttttcctttttggtaaacagaaaggggaaactcatcttaaccaaaccgttcttggaacttggagtgatatgagaaccctgtcttgccttgctgtgagaccactttccctcttgcttttcggtaaaaaattaagtgacgacttatcttttggaataaaccattctgtccccgagctctctccgcaccccctccgctccacccccacccccccccccatcaaaacctagcaggggaggacttcggggtggcttgcagtccttgctgcagaaggaaacattagctgtatttgctttgcttgattttcacagggctgcctccgaagaaaggagaatggcgttcagcaaaggatttcggatctatcacaaattggatcccccacctttcagcctcatagtggaaaccaggcataaggaagaatgtctcatgttcgagtctggggctgtagcggtgctctgtaagtcttctctctcaacccagctgatcaggatctgtttgcttgcaataattcagattcaaccttttttttttttttttctttttttcaaaagaagattctgataaccccctcattgtatttcacctcacaggtcatgcttttatttccttttaaccagaccttattgtttttcaaagttttctttgcctgctgcaggtttttgatgagggtggggagagatgccagtttgggtacagatttttgctttcttgggttctgctgctgcttctaaaagtaaatctttctttccaaaaaaatacagttgcaatgtatagcatatcatgtaaacttgtaaaacagcttgcttgacatttttgcagaatgaacagaatttcttatacctgatatttgtttaatatttttggaatatattatgatgaggctcttatattttcattaagaaaattttaaacaacctttaaaatttcatgtaaggtaggtgcttgatttcatattggttaagaaattattttgatagtttattttaaagaaaaggactactgcagcacaggaaaaataatagattagtaaggtttgggttattttgtgggcagatggatgagattaaaaatataaatattaatttgaatattacattttttagtataagattttgacaggtaacttcagtttgggattatttcaaatgtgattattgttagaggctttcttgtgataactacttgttctatattatgtttttgctatgtaggatcaatttggatattggtcatatttttaaaagttaaaaataacatttgaaaggcatacttacaactataaacccatgagcattaaagtttctccagatttggtagggaaaggctgaagactgtaatatttatatacagaatattaacatgcagaatattatgatcagttaaacctgatcttaatactcaaaaataataaaattttaccctgattgtggacatagtgacataatggaaaatcttaagcaaagaacaaagtataagaaatacgtattttttggtaaatacagtaacatggttttagtgaacaggaagaggttatatgttttctaagaaacaattagtagcatgtgttacaatcagtcaggacttagttcgtttacattgttatttatacttaaatcaaccaaactgttgcttgctacagtgttaatttgcaaagtatgtttctttgtactacaagtctcatactgatgaattctatctagatcaaagactgtctatggggaaaaggtttgtcttagcatatgaaacacttttcagctgcttgtgttttggtggtttcctaatttgtctaaattctaaatgtttctttaacggtgattgttagtaatactaggaagtcgaatttctggctgcaaagtatttattacctataggtcaggaagcctaaggataatcttaattccaaacctccagcagtcctcttttatgccaaataatggtttaaaaaaaaaagttaactccccagctatccattttggcattgctggcagtgtgctcagttgtgaatgactcttttgtgaccccttggactagagcaccccaggctcttctgtccttgtaattctccaggcaaaaatactagagtgggttgccatttcctactccaggggatcttccccacccaggaattaaacctgcatgtcttgtgtctcctgcattggcaggcttattctttaccactgcgtcatccaggaagcccattttttaagttagcgttcatattaagaaaaagaatattaaaaacattgtctttactacttattaactctctttattttcattagctttagactgtatatataagtaatggttttcaggagaagaaaacttcgaatgttgcctctctctatagagctcacataaatggatatttaattttctgagtatgtcattagcttttctattgtaaaatttaatatttaaaatattaatatttaagagctaacagacctttttataaatcatttgacttgtaaaattgacattctagtctgaatgctaccaagatgtgtactgtgctgtagaatgttcatttttaaaaccttcacttttttttgaatacaaaaaaaaaaatgtacccagggaattgtgctgggaaaatactgacttgttctatttatcttcatctttcttagccctttgaatttcagtgcatcttgcatgttaatctaccagaagaatcttctaaaatcatttttgatatttaacgaaaatgttaccccatttttcagtaagagtaagttcaaactcctcagcctgtcaattgaggccttccatcatttggccccaccccataattcactgttgacctcctttaagggagactggtgttaccttagcaccctcccaaagtattgttctttttccagccctcatcatcctttcttcctggaatgatggaatgcttttttctatctttccagtcaaagccagtcagttccagcttcaggagtcttcttccttccagaagaatctgccccacccaccccctccttcttattcttgtctcttccttccctgaatcttgtgaactttagtctttatcacaaggtgaatgctttttttgtgctgccttcattgctctctgtatgcttgtatacagtggtggaagtgatcctagcaggactcagccttctggtacccaaagtttatgacttctattggctccagttgtccagctctaaagtttaaacagttagacatcttaggccatacatatcgttaaagattagtcacttacttttcttggcataggccagaagtgccatgagatacccaccatgaaatgtcgtctttccaattactggcatacgttaaaaaatagggtgcgagtgaaaatcagttcctggatcctcttagggcttgggtatccactaatcagtccagtcctgtcttcatgttgataaaaatgttaaatcagtcctgatactacgacttaatcagtcagtgaaccagtgtctttcagctctggatgcacattacaatttacaaatagtgatgcctgggctccagccagaggttctgatataattagattgcgatgactgtttctgagcatggtttatgtaggctttcttatgatagattatggcataacttttctggcttgcagattttatccaaaaatgaccatgtttccagaattttaacgctgtcgttgtctactgtggggtcagaatggcaccccactccagtactcttgcctggaaaatcccatggtgggctacagtccatggggtcgcaaagagttggacacaactgagcacacacacgtacatggcgtcagtaatgaattttcttagaactcagcctgaaccaagtgccgatgttcccgtagcactttcagtctacgggaacatcacagaacgggaaacttgaagtttctgtgtctcagtgctgcactccttgagggaaaggcccagatctcattgtaatgtttgtatccctagtgtttagttcagtatcttacctgtattgcagaataaatgattattaaataagtggcatgggggaagacttacctaaactatattatagtattctgtgttgaaagtgttgtaccttttcgtataaaattgattctgtatcttttaaagaactgctggttgaccaaattgctgatttaaaacacatatattaacatgttgtttggatttgttactgaaaaattctgttggaagttttaactattagcattaactattaaccacatcattaaggtttttctgaaatgccagttaaaatctgtgatgaatgttgtttataacttcataagtacgattaacagtttgttttaaaattacttttctatttaggtagaaaaacattttgttatttctttcattgcatgtatttaacaaccttctgaaacattcttagataatagttaatatgctttttagtagcatgctcatttttagtgttagtcgttttttaaaattaccagttcagaaaaatattcagttgaactgaaaatttggtgtctgtggagcagtgacccagggtatcagctgtgactagtatactgtgctgaaacagcataagcagcaagtgtgatggtcaacaagttataacactacatatttcttcttggaactaatgtaatgtagtaagagataaaagaagacatctgtcagttttgtgtggagttcagtttttctcctctttatacggttagacacatgaaaagaccatcacgagggaaggacaagtagccagtcagacagacagatgcataaaatgcacaggctatcttgttgtttttcagcccatctcatgtttctgtaaagggaaataatttgctttataattgtatcctaaatagaagatggagtaaagagaaggtcagcccagaggaaatggaggatgatgctcaaaatagaatttatgaatcacctgtttaaaagatggggatgtaaattgttgatataaattcctgactcttaaaaggagagcttctgttctttggtatcacatgctgatgtggtaggaaggattaattgcttttatctgcctagtggcaagattattttcaggccttaactctggacatagttttaccccaggctgttagtctaagttttttgtctacctcattttttttccctctcttttgtcttatcatggaaacatgagccataaaactttaggacagtattctccagatctctgtcacagaacgtgaagtgaaactgcatactgtgaaggagtcatgattgccatttactgaaagttactctgctagtccaacattaagctagaggtgcctaaactctcttgtctcatggcatcttggggtctcattaagtttttaacagcacccttaagtcactgttatgttcattaagtagttaggtccaaataataaacatttacatcccaacaactttagtagctgtttggaaaaaatgatgccaagaaattgaaaataatttactttgttcgtaaataaccacaattatttactcaaagtttggggtgcctgctaagcactgaacagcttttcaaaccttggcaccagattgaactgaacagcaccaccctcattgcctgttccgcattgactttggagtggaagtgttttgttttgttttgttttttagtcagagaaaccactgaaaactcagctgcccaaagatatgatgtcataaaggaatgtactgcaatcaaatgttaaaaactctaaaccaccctagtgtaatagtttgggcagttcttagcatgtagtgagtatttccgtgtttccttccatttaaaatatccttcatctctcctgggagtttgctgaagtgtcctggaccttctcagcatagagtttagactgtggcactagacttgctttatttcattaaattctgtgggttgtacttttatccccatttcgaaaaagtggaaactgaggcttggagagattaaataactactccaatgacatagtcttagcatttgctttttcaccgtaattattatttgggctgctgttagggtggtggttattgtttggggggttgaggaatgaatagcaaaaagacaagaatgcctatagaattttaaagttgagtgaaatgggcagcattttctaacgagggaagtgttaaacctgctgtgttttgcctacaaattattactatataagggaaaaaacatggtttgatttagcattaggtcattaaaaaaccaggtttctttgccaggccaagttaaatgtcagcttttagaattttggatgacaactgtggtaggtggtgataaaaagcagtatccgtagttttttctttttttttaattgccacatgctaccagtcaccatgattgccctttagataagttacagtgctttatctttttttaagaaaaaatttcaagctgaaagaagtgacttttttatagttgacttttgctgcacagaaaaatgaattttagacttgttagatacgactttatgttagggttgcaaaatttcactttttttctgtaaataatttttggaatgttcatatttaataaaaaagaaagtaaatagcaacttttaaatatcaatgcttaaaaaaagaaaattacccttcctcctccatcctgggcagcagggttgttcagtggctcagtcgtgtctgactctttgcgaccccatggactgcagcacaccaggcctccctgtccttcactaactcccggagtttgctcaaactcgtgttcatcaagtcagtgatgccatccaactgttttgtcctctgttgtccccttctcttcctgccttcagtctttcccatcgtcagggacttttccaatgattcatttcttctcatcagatggccaaagtattggagctgtagcttcagcatcagtcctttcaatgaacattcaagactgatttcctttactagcgactgctttggtctccttgccgtccaagggactctcaagagtcttctccaataccacagttcaaaagcatcagttctttttttttttttttttttaaagcatcagttctttggtgctcagctttctttatagtccaactctcacatccatacatgactactggaaaaaccatagctttgactagatggacctttgttggcaaagtaatgtctctgctttttaaagtgctgtctaggtttgtcatagcttttcttccagggagcaagcatcttaatttcacggctgcagtcaccatcagcagtgattttggaacccaagaaaataaagtctgtcactatttcccttgtttccccatctatttgccatgaagtgatgggaccagatgccatgatcttaattttgtaaatgttgagttttaagccagctttttcactatctttttaccttcatcaagaagccctttagttcctctttgctttctgccataagggtggtatcatctgcctatctgagattattgatatttctccctgcaatctggattccagctgtacttcattcagtgcagcatttcacatgatgtattctgcatataagttaaataagcagggtgactatatacaaccctgatatactccttttccaagttggaaccagtccgttgttccatatccagttctaactgttacttcttgacctctatacagatttctcaggaggcagatgaggtggtctggttttccattctctttaagaattttccacagtttgttgtgatccacacaggcaaagactttagcagtcaataaagcagaagtagatgtttttctggaattctcttacctttcctatggtctagtggatgttggcagtttgaactctggttcctctgccttttctaaatccaacttgcacatctggaagttcttggtccacatactgatgaagcctaggttatcctgttgttataacatagggctcatagtagttcctgggcttcccaggtggctcagtggtaaagaacccgcctcccagtactggaaactcatgcttgattgctgggtcaggaaaatctcttggagaaggaaatggcagcccactccagtattcttgcatgggaaatcccatgggcttaggggcctggagggctatagtacatgggtttgcaaagagtcagataccactgagcaactaaacaacaatagtaggtcctaagtgctttcattttttgccacttaagtttgctataagaaaattaagggtgaaggcaaaatttctgtctcactgaatagtaaagcctaattatgtgaccttttaaaagaatatttatttatttatttatttgactgcaccagttcttagttatagcatgtggaatctagtttcccgaccagggattgaacctgggtcccctgcattgggagttcagttttagccgctggactaccagagaaatcctatgtctcagattttctaaattgtccttaaaatatagcttaatggtataacaggatctagatttgtcctcccactttatataataacaacaaaacaaacaaaaaatgtgaaacagttgtcagctcttgaaccataggcagcacaagacactgatccctgagagaagggaaacaaatgaggtgattcttgtttgtgggttgctgccttgagagtttccaggctacaatagcatcaggaggaacccagacaaagcctggcagtctccccgaattgagacagagtagggactttggggaaactggggcatctagagttctcaggactgagtaccagcataaggatatctgcacagagctcctgagatgcatggtgggttccacgtggtccctcagctgagttctgtttggtaccagtgtgagaggaagctaccaagactgggaaagaagcacccaaaaggagccagcagaaaaattcctggtgctcacccaggtctgggaataggtcatggtccaaacagccagaattgagaaagctgtttggtttgagcaccccgagaggggtatatattggttcattagtgggcccaagttgctctcaaccacatgctgctctggtcctgcccaacaggcttcaaagcaacacccaaagggatcaaactgtttgcaactagtttccaaatagctcaactgtatcacagaacacagtttagcactgttcacaggaacacaaagtgtatatacatatatccagcattcaaccctgtaaatttcacagtgtctggcattcaattaaaaattaccatgcatgcaaagaagcaagaaaatatgccacataacgagaaaagtcaatctgtagaaacagatgctcaaattaataagaacattaaaacagctattataaatatactccgtatgttcaggaacacaagaaagaatgagcatgttaaggagaggtatacaaaatgtgaaagacccaaatcagacttctagaaatgaaaacagcaatgtctgaaatgaaaaaaatacactgatagggattaatagattagactgcagaataaatgaatgacaaatttgaagatgcaataatagacaactcaaatgaaacatggggaaaaagacttaaatagataaacagaacatcagagggctgtgggaaaatctcaagtggccggatatatacacatgggcttccctgatggctcagctggttaagaacctgcctgccaatgcaggagacacaagaggtacaggtttgatccctgggttgggaacatcccctggaggagggattggcaatccactccagtattcttgcctggagaatcacatggacagaggagcatggcaggctacagtccatggggtcgcaaagaatcggatatgaatgaagtgactgagcacacacacatgtatatatagttggaatcctaaaagggaggggtggagccgggaaatatttgaagaaattgtggctgataattttccaaagttgatgaaaactataaatccacagatcctagaagctaaatgaaccataagcagaagaaacatgaagagaaagaactacacatggtcaaattgcttaaaaccagtgacagaaaaattctaaaaataatccaagaaagaaaaaagacatatgtgtagaggaatgaagacacgaatcatgatagacatttctttagaagcaatttaacctgggacttccctggtggtccagtggttaagacgccacacttccagtgccgggaatgtggattagatccctggatgagcggctaagatcccacatgctgtgcagcatgactcaaaaaaagaaaaaagaaacagtccaacccagaggagaaagagctaggtctttaatgagctgaaatggaaaaaaaacagaagaataatgaaaaaaaaaaaaacaaaacaaaacccaaaacctgtccatctagaattctgtactccatcacaaagaaaggtgatgtaaagactttttagatgttcaaaagccaaaacaaaatgagctaattatatgaatagcgatttagattagtattgcttttctttatatctagtgccagtattttcagaaattctgagtttataaagactgagtcagttttgttaattgtgtatatgtgtgtgtgtgttatttgcttagttgtgtccgattctttgtgaccccatgtactgtagccctccaggctcctctgtctggaattttccaggcaagaatactggagtgggttgccatttccttcaacgtgggaatcttcccgacccagggatcaaacccaggtctcctgaattgcaggcagattatttgccacctgagcctccagggaagcccattttgttacttagttatgtttaaactctaaacttgaaagatgcagaaagagtggaatggacttatgcagttggggttagctttgtaagtagagtgccagaaggaggtttatctgtaaaaaattgtgtcttatgttttgatggtgacacagttgcttgagatttttaatagttgttaataagaatttgtgttttatctttttccactaaaataggttttgcctgtttgcctataatgtaagccattgttatccctctgtaatgttctacagtatgagcagagcattcatgttggcatacatttcgtagccactgaactaatagaattactgtgagtgcatttggagagatgcattaactctccctcgtcaactggacactatttaattactcccacatttcaggttgaaagactgtatgtgccctttacactcctagatgattctgagataacttaagtcagttaaaagtaaaaagagggacttccctggtagtccagtggttaagaatttgtctaccaatgcaggggatgagggtttgattcctggtcagggaactaaaatcccacatgcagtagggcaagtaagcctgtgcaccgagactggagagccagccactctagagcccagcccatgcaccgtaacaagagcagcctggcgccctgcaggccatggggttgcacagagccggacgcgactgagccactgaactgcgctgaagaccataggatggggttcccaggtggctcagtggtaaagaatccgcctgccaagcagcagacgtgggttcgatccctaggtctggaagatcccctgagaaggaaatggcaacccattccagtattcttgcctgcaaaatcctgtggacagagaagcctggtgggctacagtccatggggtcaccaaagggttgtggacacaacttagcaactaaacaacagcaacagaccataggattactgtagtctgttgactaccttactgaaatgtagataaacaaagtcttttaatatcctgtggttcatattctaagcataggcaggatgaatcatactattaagtaaattcctagctgctggtacattagtgctcgttagtggtctgtcttggtcagcgctagggaagtgacgttggagaatggggtagaaatgtagttaccagatgtgtagatgttacaacactgtgtgggactgacacagagctgggtaaaataattactgattgtggacggcacagttgagatccaacttttttagactgagaaaatggattagaacctgaaacatgaaaaatgcactttccccttgtttaatttttgtgtccattcctgaaccacgtgctgtgtgtgtagggccagcaggactgcttgggttggacagatgattggcaacaggagacaactttgtgtagttgtctgagttcccataaagccgctaccagcaggatgctacatagtaaggaagggttgatggccaccttgaccactgtgttccttcaaacctgctcttccttcagtcttctttactcggggagttgccctccatccccctggctgtttaaaccagaacttaagaatcaccctctacccctccttcactctggttttacacattcactccattaccaaatccagtcaactcaacctcctaatttcattgagaatccatgcagtttaccatttcagctggttttgcatcagtaatgccactgcattctttttcatggaccattgtaattgcctcaactggtctccctgcttccactctccccacccaactctgcagtgtttttaaatatgcagtttacttttttaatgttttaaaagtttgtttattttgactgcgctgtgtctttgttgctgcgcctgggtttcctctagttatagcgagcagggcctattttgttgcggggcatgggctctaggcgtgcaggcccagtgggcatggtgcatgggtttagctgtcctgtggcacttggaatcttcctagcacagggaacttttgacccctgcattggcaggtggattcttagccactggaccaccaggaaagtcctaaatacacaattgagatcttattcgcctgctcaatacccttcagtggttggccactgaacttaaaatgcagagtctttaaaatggcctgcagtgaagtggagccctgcccccctcctcactcttacactgtactgtctcttggtttctgtgttccagccacattggcccttttttaagttatgaatgtctcaaattctttctggtctcagggtcttcacatatgctgttgcttctgctcaagattttatttttaaaaataaacttgttcacacatgtggaaaagtacataaaccataaatgttcaacttgatgacttattacagagtgaacatattaatgttgccactaccaggttgagaactagaacattattgctggctctcctttccaattattatctccatcatgatatgcagagatcataactgcacgattgcttgcatcatagattagttctgtctggtttccaacttaacataaatgaaatcattcagtaagtattctcttgcacccagcttctttcattcagtgttaaatatgggagatcttgcttgtgatagcgtatagcagtagtttattcattttcattgctatgtagtattccattgtatgaacgttctggtgttctgttgacattggctttattttcaattttttctattacagatgattctagtatgaacatccttctacatgtctttcggtgcacatactttaatttctctgttggatattcttaggaatgaaatttctggttttagggtatatggatgttcctggaacactcttaacctttactcttcagataccaactaaaaggtcacttccacaggcaggcaggcaggcaggcctgcctccaacaaacaattttaaattaggttctcttgctgcagtctattggaactccatcattgtgcttaatataattttgcacttgtgtgattatataatgcctgtcttcccaatggaaggtattagggcactgactttttttattcctggaatagacattcagtacagacttattgcaccaatgagtgaaaggttattttgaaatgttactaagattggggtgtataatttatatagaacactaatttggacagtgggttatctttcagctaaaagtttagttatttaatagtacaaagaaaaccattttcttttcaaataatttttttctttatgtatgataaaattgaaagaggctttcttgccagctgcttacatgatcttaaatgaatcacttaacctctagtctttttcttctggaaatgagtagcttggcctgtagacctcgaggatcctctgacttgaggctctctacatgcaaataagccaaccacaaagtgcggtgcatgcaacctcaggcaaattgtgattctaggcagggtatgccgatttgtcatcttgttttcatattcttaccggcttttttcagcttggtcttctgaatcagctaaggaaaggtgtctgttcccacctggaaggcttgagccacagtagaaggttgaccttggatggcaggatcttaactgagtaatgtaattatttagcttgaagtattgtaattcatcagaagttagaggaatctacatttaaatttaattcagaaataccatggacgtttttaaagaaatgacattttttttttttattactcaaaaatgcttcattttttatttagttttctgactctgtgcttgtgctttcaacactttcacaacgatcttctgctcctctttaaggaaagcgtgcttgatcctgtcacggacacatttagcacacatggaaccaccataggcttggctgacatgcttattcattttagacaatctcatgagaactttaggtttcacagcacgaacacctctaagtcagcctgggcacacaccacatgcagattttggttttttcccaatctccttggtataaaggtaaacaactgtattaccaggggttcgggacagcctggttttgttagaggctgtattgtaggacagcctacgatggtatgtcagacgttgcaccatcctgaatgcctgtagctgccatccccacaagaggaaaaaggaagtccttgcaggttcaagaaatgacattttaaattatctgatgatcttagatcataagatctaattttgcttctttgggttcagatggtggggttattagcaaggcgggtatgaccaccatgtcacagttatcctgtttattaagcctctatttagattcataactcaggaaagtcaataaataggtatatgattgttttcatctgaatttctgtacctgatctttttttaaaatttgtttattttcaattgacagataattgctttacagtattatattggtttctatcaaacatcagcctgaatgagccataggtttacccatgtcccctcccacttgagcatctctcccacctccctccccctgccacccttctaggttggtactgagccccagtttcagttcctgagtcatacagcaaattcccattggctctctattttgcatatggtaacatatgttccatgttactctctccatatatctcaacctctccttcctccccacagccatgtccaccagtctgttctcaatgtctgtgtctccattgctgctctgcaaataggttcatcagtactacctttctagatcccatatatatgtgttagtatacaatatctccaaataggaaaaggagtatgtcaaggctgtatattgtcaccctgcttatttaacttatatgcagagtacatcatgagaaacgctggactggcagaaacacaagctggaatcaagattgccgggagaaatatcaataacctcagatatgcagatgacaccacccttatggcagaaagtgaagaggaactaaaaagtctcttgatgaaagtgaaagaggagagtgaaaaagttggcttaaagctcagcattcagaaaacgaagatcatggcacccagtcccatcacttcatggcaaatagatgggaaaacagtggaaacagtgtcactttattttttggggctccaaaatcactacagatggtgactgcagcaatgaaattaaaagatgcttactccttggaaggaaagttttgtccaacctagatagcatattcaaaagcagagacattactttgccaacaaaggtccgtctaggcaaggctatggtttttccagtggtcatgtatggatgtgagagttggactgtgaagaaggctgaatgctgaagaattgatgcttttggaatgtagtgttggagaagactcttgagagtcccttggactgcaaggatagccaaccagtccattctgaaggagatcagccctgggatttctttggaaggaatgatgctaaagctgaaactccagtactttggccacctcatgtgaagagttttctcattggaagagaccctgatgctgggagggattgggggcaggaggagaagggggatgacagaggatgagatggctggatggcatcactgactcgatggacgtgagtctgagtgaactccgggagttggtgatggacagggaggcctggtgtgctgtgattcatggggtcacaaagagtcagacaggactgagcgactgaactgaactgaactgaactgatacaatatttgtttttctgtgtacctgatactatgtttcattatttgccataaattctcatttgaaaagagaggtataacaccagcaatgctgagtaatgccagtcacgtcatatgacatagtaccataaaagtaagccagtcgaacagaaaaggtgttgaatattgtgatagagaacaattggtaggttaaattttgatagagaacaattgatctatttatacactgagtgttttctgtagtctataaagagatcaaagagtttataaagctatatataggtttatagcttctattttcattattttcctgtagcttaaataggaaatgtagattaggcctaccttcagacattaatttgttcaattcaaaaactgtgaaacaccctcagagctaaaataatgactaaaattgtaggatatcactagctcatggctttggtagttttaaatacttattaactacttctccgatggtaggtgaaggcaaccttatgatcttccaactataactttgacagggggctcccctggtagctcagtgataaagaatttgcctgccaatgcaggggacacaagttacatccccggtccaggaagatcccacatgctgtgggacaactaagtccatgtgccacaactacgaggccacaaccactaagtcacctgggaagccccatcagcataagaaggactattttctatgagaaatatgcaaaagatttatgacagaatactagcaatatatttcatccttaaatattttttggagagtatgtgcttatagcacatattttattttgctttaaattcttttctgtgacctgattcctgttcatatattcagtaggagtagaatcctagggccttcagataatcaatcctaatgatatgagattatacttaaaaatgtaactaaaattataaatttacactgaaggtagctcagtgttctctggaaatgcacatttgtatttagagtgaagactaagatttaaagcatgaatgaaagatagtttcaaacatgagaagaaaagttttgcctttaaaaaaaaaaattatttatttatggccacatggcttgtggaatcttagttccctgacctgggattgaacccatgccccgctgcattggaagcacagaatcttaaccactggaccaccagggaagtcccaagtttttccttttaaaataaggaaaataagagtggagttaacatactgttgacgtctgaagtgtaatagcagtaacttcagaagccgggctctgacttgacttccgtgcttaaagtgtgagctgaagaggtggggccttcttacttcagctgaactgctcaagatcctggctcagaaggacttggaaaacaatgggcttcttggccattcattcatacctactggtgtttagaaaccagtcacttgtaaaaaggaaggcttgactttcctagcatttcatttgttaaatagcaacaacatgaagaggaaaggggagaaaaaaatacctcttacaaaaatcagtccgttcccctcatggaaagcacagtggagaacctttttatcagcaaggcagcacttaggggagaatgagcggcctgagcttccgcacagccaggcttcctggactttgagctctgctcctcctctcactctgtgtcctccgagctctccgcccctgctgccatttcctgtgctccatagcgtggatcctggtttgcagtcacctaatggtgcccatcttccccatctctacttcacccctcaccacagacatcacattcgaaaattgcctcctttactgtgaggaattgttaaacttcaacgatgagggttttcaaatgctgtcagtggtaagatgtaatgtttatcttctttgcatatttttttaaaactaacaaaccattcccttttatgcccaaacctctttttttttttttggagttaagttttatttggttcaaaataaggactgcagcccaggacacagtgcctcatatagttcagaagaaatgttcctctcaatttattatttttttttctgttagatgaaaatctagtcagcagctgcagtgttcagaggcttgggttaggtgggtatcgtgttgagatataagtaagtaaaacctagtttctattgctattagtagacaagagatttccttccagccagagtactcagggaaaactttaggaagaaagcagcatttttggttaggtattgaaaggtgatgggcttccctggtggctcagtggtaaagactgcctgccagcgtgggagaccggttttgagccccgatctgggaagatcgcacatgctgaggaacagctaagcctgtgcgccacgtctgctgagcctgtgctttggagcctgcgggtcgcagctactgagccagtgcacctggagcctgtgctccacagcaagagaagtcacctcgatagaagcctgcgcaccgcaactgcagagtggccccactcaccccaactagaggaaagccttcacagcaacgaagacccagcacagccagatagatcaatgactaacaaatattcaggatggaaagaacgctgtgaataaggaaagggaggtgggggtgaagaacacggagcctgtaggaggcaagcacattctggttttggctgaagctgggatgcgagggtagagtgttaaggggacaagaaagatggggatggactgagtaaattcgtgacaaatgctgcgttttatctaaaggttatacacgttattttaaagcgttatggctttcctattttaagtgatctctttatagtagagattctcaaattgttttctagaaattaaattatcagagaaatggaacaataatttagtcaggtccctcctaattatatatttctcagtatttcatggagtttcataaaatacgggagtcttttttttcccctcagttaaaaaaatacacatatgggaaggaaataaaattgaattataagtaattatcttaatgccatttagagatacagacttcttaatttaggaatatgcacatgtatttctaacagctatttttgctggctacattaaaatgaaaaaaaaaacacattaaataatgttacatgtatggaaaagttgaagttcagcacaaaagaattttctttttctgaactatttgacactattaagttgctaacatgaggtaaacagggtttatctgtttcccctaaatgctttattataatatttcctagaaaggcattcttctgcataactaccagataaccgtcaaaaaatgaacatggtaccagctgtccaattctcagactctattttagttcattagctgtccgaacaatatctttcatagcaaaaagatcgagttgaattgtgtatattatatttagttatcatgtctctttagtatccttagatgtggagaagtttcccagtctttgacatttatgactataaagtgttatggcttttgaaggcgagggccagttgtttggtagaaatgtccctcactcagaatttgtctgatggttcttcctgttcagagtcatgtggtgttggcaggaatattacagaacagtgtgcttttcatggtatcctgtcagctgacacagtgttgacttgtcccatttactgttggtgttcactctgataacttgtgttgatgtggtatctgccaggcgtcactggccagctcttttttcctttataattaataagtgtttgaaggtgaggtactttgagactgtgtatgatcccattgctcttcaaactttaagtttatgggtttattcagggatttataatcttttactcttaaaatttgtcttaaaattgtcccaaattttgccagaagaagaagcccctttaaggctggcttctgtatttttgtgacgtgccttaattgttctttgaacacttgtttactttctggcacaaaaatttgttctagccttgtcttgcccctgctgttctcctggaatcagccatttctccgtggagtcctagttccttttagtggagaatgtattagaaagcaagatctgagtgctggctgtgttgtctgttattgagcattgctgatcacaggtcctgtcaattgatagagtgaaggaaaatgtataagcgtgtatgtatatgcaagggtctccccctggctcagtggtgaataatccgcctgcagggcaggagacacaggaagtgaggattcgatccctggaaaatcccctagaggaggaaatgtcaacccactccagtactcttagcagaaaatcctgtggacaacggagcctggtgggctatagttcatgggttgcaaagagtcggacacgactgagcacaagtgggtctatgtatttgaaagtataattatgcccacccatttctgtctttgtctgtctctctagaaaactgagttcacagtggtaactccagttccgatcagcaccacagcatcttttctggttttctctctgtgtttgtactgcccttttccgacagtgagaaacctgctccgtggttcttggtcgtccccctgtgtataaccaaccactctcctgttgccactacagcctcatccaccccacgggtggcttccttgccccactggggctctagcaccctgcttggagcctccgtccaacgcaccgtgccttctctactctttcaagctccagcatccttttgcaggccattcccaccattcctgggtggacaccacccttcttactccgctcagacttcatcacctcctgcccgctgcccctcccctcaaatggagtctttctttccccacctgtggcttcaactccatgagcagggacaccttcttactctccctggactcacagcctgcgaaggacctccttccattctaccccacacctttgaagcataaatgaaacaacagttaatcatctactgtcctttagagtaaagatatttaagaaggaaacactaggttttcttttataaaattggaaggatctagaggtaaatgttcatatggttctgaaatcgccttcaccagttcactgaacataaattactgaactcctcctgggtgccaggcactgagctagcccaccggggacaggccagtggattagacaaagccgcttccctcaagaagctgccttctctgactgttggagtgtagccagggtagtaaattagtaacctccctaagcctgttccctcctgtcaaatatttgtcactctaaaaaataatttaaaatttcatttaatattttgagaagaaaccaaaaaattcctggcagggaaaatgacatctcatctattctttgaatcatttttctttcctttagcattattttagttaagaatatacactttaatttaaattgtgtatgtttgtgtgtgtgtcctgttccctgagtctcagaatataatacaaaagcacaaataactaaacagtatgacatttgttcacctgtttgaatcaggtgacagtctaatagatgggtcttctttgggcctgaaaaacatggtagattcatatatttggagcacagttattgaaaaggtaattattatgcattattagaagagagaagattttgttgcatggtaatttaagttataaaatgactttgtcttttctaagggaaggtgtatgttagttgcttaggcatgtctgactctttgcgaccccatgaactatagcctaccaggctcctgtgtccatgcgactttccaggcaaaaatactgaagtgggtggccatttccttctccagagggaaagtgacaacttaacactaaaaatatattttctttttaaccctattactggtatttgaacctaaatggttggtgctaaaactgatagatatatctggtaatttctatattactgtactagtggtagtgtttgaaatgcatataacgtgtaaactctagaatagaatttgccctggaaaccatgccttctatcatcagagagataacaagcctctctaaggtttgcttttgtacattttgtacttacaaggcaagatgtgggagaaggggttcctctattactttaaaattaaaaattgtgttgtgatattttctaacttggagaaggcgatggcaccccactccagtactcttgcctggaaaatcccatggacggaggagcctggtaggctgcagtccatggggtcactaagagtcggacacgactgagcgacttccctttcacttttcactttcatgcattggagaaggaaatggcaacccactccagtgttcttgcctggagaatcccagggagcggggagcctggtgggctgctgtctatggggtcatacagagtcggacacgactgaagtgacttagcagcagcagcattttctaactctgttccttgtcattgaatgttaggagtaacttctataaatatatagtgtaacaaataataatgataggaactctaggaatgaagaatgaaattcacatcgccataactttaatggcttggtgaaatcgtcctcactccctaacttcatacaggtggtttgataaaaataaaggcccaccgcagtaaagagcatgctaaagaagtgtgacatcatcaggtggctgagtgagtgactcagtctttttttaatatttatttatttatttggctgcatggggtcttagttgcagcattccagatctttagttgcggcacgtgaacttctggttgccccacgtgggatctagttctctgaccaggaatcgaatgccggccctctgcattgggagcttaggagtcttagccactggaccaccgttcagtcttagcctctgctgccaactagcagagcacagctcattcgacagcagaagtgggataatcaggaagaagtctaaaagtcagtggtctgaaaagaggtgaggcaggcagggaagatgagctgtctggagaaccctggagacgagcttcgagacaaaggaaagagctttaatgcagaatactatgggatattaggcaaagcagtagactgagactatggccgttttgttggcaatagagatcaacagagaagactgtaagaatctgcttacaagcgtttgtaaggtggaacacatgcatattgtcaaaacatattcaatactgtgattctgtatcagaatgtaatttattagaatatttattagactttgtaatatactgtattttatgtgcaaatctttgagaaatgagagaagggaaaagtacaagagataagagataaataaggagtgagccagtcatctaagaggtgaactgggagctgtggggtaggctgtggattagggagggcagtgaagaaggaaagaactggaaaggaaaggatggaatgaaaaagaggctcctgtctttccagatttgtaggccttagaaggtcatatttgctattgtacattgagatactagctgtggtttatgtttctttggttctgtgtccagttttcaataagtgtgtttgctaagaactcggaaggttttcctttaaagcttcaggatttgtttttgttttttctcaatagaatgaccatcacagcctgtctaagggaaattgttctgtaggttgtattcattagtggatgacattaacttcatagcagaagaaataaatccagacgaaggccagactgacaatttccctgtccctgtgcttgactcatgtggtcaagcattaccattaactttcataatttaagcgttagtagtcttccatgcgtcaagctctgttctaagtgtcaacgattaaagaatgaataagacaagagttccaccttcagggaacaggttggctaatgagaaagacaagtgatgaatatattttaaatgttttggcaacatgaagagggagctctgtgaaattcttgtgcttagataaataaaggtttcaagaaagtgactttatgtctttgtttttctaaggtgagttcagttttggccagaggcaaaagttgggtcaagccttgcaggcagaaagccagatcactgtgcaaaggcacagagatgtagaaagtgtgtttgggcaacagtgagcgtctcatgtgactggggcataaggtgcatgggctgtggagggaaggggagcaatgaggactgaagcagaaacggtgggttgaggctaaagtctggaagagtctttgttaaggggttgggtgttgtcccgtagggatatcaggacgcagtgtgttcctggtattaagattagctaaacagatcagggggacagcgaagaaaattcaaaagcaacctccaaaagataggaatattattaaagatagtaagtacttcaggatcattaggcgaggatggattcatgaattgatggtgctggaataacttgttacttctttgggaaaaactattaaagttactggttcaaaaaaagattttatgcagtacatttatgttaagaatatcagacttagattcagactttagatttttggttgaaactctggctttatagctaaagcgaatctggtgtttcaggtcctttttcttatactaaagcttttttttttttttttgtagcatcagcagaaaaagaggcaatcaagggtacatactccaaagttctagatgcctatggacttttaggtgttttacgattaaatcttggtaagtattcaatataattcaatctgttttttcatttctgtttttgtaactttgaagatttgatagacattatttcatagactctgtatttgatctgtgagtataatcatctcttaaccttgagatggttgttgcctgaaaagccatgctacatgctcatgctctcatgattctaaattccagagacagcatcctgtctgaacactttaagagatagtaacattgttagaagagaaaaataagggcattgcccccttttttttttcttgcttcagtgcacttaaggaaagatgtcttagaaccacacactgtttcccctggtttgtggtggaaaagatacctgttttctactcaaaacatctcagcttgagcctgtatgccattcagtgtcatcatgggctgcaaagtaacatttgtgatcaccagttctacaacagtgtgactcagagtgtggcccacggacaggttacactccatgaactgttttgttagtggtctggatgagaaaagaagctggtgcggtcatgcaaatcaacacatggcttccttcattgataaagtcttactgtggagaaaaaaaaagaagtcagctaaaccaaatagagaacttagtgaggcagttttctcttctggagcaagcacctgttctcactaaactggtaactgaactagtccatggatagtactttgaggagcactggtcttgtcaaatggagatatgccattcgttatgagtctgtcacacgtaaagcactgtgtgtgcgtgcgtgctcactcactcagtcatgtccgactctttgtgaccatgtggactgtagcccaccaggctctagtgtccataggatttcaggcaagaacactggagtggcttgccatttcctcctccagggtatcttcccgactcaggggtcaaacctgattctcttgcatctcctgcattggcaggcagattctttaccactgtgccacctgggagcacttaactagtattgccctggatcatcctcacagtccaatgagatttgctttaatctcattttctttttttatttattttttggccacccctcatggcaggtgggatcttagttccctgaccaaggatcaaacttggatccctgcattggaagcagagtcttaaccattggaccgccagggaagtcccttaatcttattttctaaaggcaggatatctcatgttgcatatgttaacacatgaagttggttgatgtaataagtagtggagaagccaagatgcagggcatttctgcctatgtcaagcccccacatgctcaaagtataccactgctgaattccaccttcatactcactgcacaggatttttgtcaaaattagatgaaaaaaattgctatgaaagtttttgtcagccaaatcactttataaattgttaccaaagactttttcttcacatagcagcaacagcagcagcagttcacatttaaatgccattttttcaaccttactgtttatgaaaaactctcaattcattgtcttgtctgaacgtcttacaatcataaaggaaaggtagggaagataacacctacattttaaaaatttgataaatctcacatacttttaagtagaggaataatttcataaatgtaagattattctgttaatgtttaaatgcttcatcatactaaatgtatttaacaaggattttttctcccaacttctgccaaaatcttgttgtgaacttaaatgtgtctatgataaatttaaaataaccacactgtcagattttaaaagacagagacactagaagaaagttggaagaaattttgaatagcttgtagaatattggcacttcccatcccattaagtctttggtttttgcaggtgatattatgttacattatctggtcctagtcactggatgtatgtctgttggaaaaattcaagaatctgaagttttccgagttacttccactgaatttatatcactgcgagttgattcttcggatgaggatcgcatttcggaagtgcgaaaagttttaaattcaggaaacttttattttgcatggtctgcatccggagtcagtttggatctgagtcttaatgcccaccgtagcttgcaagaacacacaactgacaatagatttttctggtgagtttgtattacgttttcccttgtgatcacgtgcagtgcagccactggtgagctggaacatggaaggcataacagttatttctagagtgggcaacggtgggcacggccagttgagcacaccactctttactgttgcgggatcctcagtggagcatagcagatatctgccatcgttttattaaagtagtcctgtgacgtgaaacccatttactcttcctgatctagacagaccttccattgcagacatatatttaaaatatttatttttaaatcaggaaggaattaatcataatagaattgtgttattcatatgtatggttcttagtttgagatctcatctctggccacatttgcctttctaagcctacattcccttattgttttaattggaaggttgtaagtaaatgattttttttttattcaagagcagccgactacagggaagtagtatgctggaatcaagtttagtactgtaataaaatgggacttaagtaggtaactgccacatatttcgggattatgcatgaaggtgctgtatggtaagtatgcgttaatggggcagcaggacccacatgactgtaattggtatcgctttattggaacagaccagatttccagtatagtcgttctcttgtccacagtcagcattgctgttgacttttttccttaacacaatggacaaattgtatttcagttgtttacttacgttataaggccaaagtccaggactatgctcacagcttccctcagtaattcagactcgggggttccccactgtatactttctctctctcccacttccactatctgcctgaatggtcctggagaaaggccctggggatcagagggctcaaagtcagcaatgctaggactggaaactacatttagagcaataacttggtagcttgtagctcccatagaagtgtcttggcccagagtggcattggggagccaagaaggcagagggaaaaggggctttggagcgctgtatctggagacttggagcctagcggagggcgaaaggatggcggtggggaagggagggcataggagagatgagtcggcagtcccatctgctcatgtcaacccggcacttctctgatggaagagacactgatgtttctgaagaagctgatggcgttgcagctggtcttagggcagctctccttacctttcttccctctgctctttctaaccccacatttcttagattgagagagaaaagtttctctgccgtaatcaagtccaggcaaatgcagatgcattggctaaatggccagcagttaagaatatcacaaagtttaatccgtgggaataattcttttatcttttcattcagttatgggtagaagtgggggccaatttagataacagattgaggaggtttatgagctggaaacaggctgagcaaagaggaggctgaaatgctaaaggtgagttttgctcactttatagtctttaaagctttgctaaggattagagtctggagcttcactttgcatagaaaaaggaaagcttttagaattcattatgccaacccttgcagctttgtagaaatatttcccaagatacagccaagtaagttctgtagccagagagtggcaaacacctatcccaaaagcccatgtagttttaatccattggggatttgaggctgctgccagttgagagtcaagtgtaaacttaaatagaattaaaacagcaaggcattgactgtgaagaaaaacgaaaactgacagcagagggagaaattctatctgaacaaatacacggctcccactgctatttaaatgggggacaatcagtctgtcctacctctgctatgatctgggcctcagctttggtatctggatgaactgggtcacagccagtttgagctttgccagttcagatcaaggtagatattaagtaaagtgtggaaactgaagtcacgtttttaaattagtaatattcatcggatttaacgttatcccaagagtaagcctactactcactgactttccagtctgctttcttcagtggataagagaggctggggttatatctggtttatcaggattacaagtggccactacctgtttactgtcccctgcagcgtagcctgaagtggtggggactggaaagactgctccaacagcattgatgtagattcttaacaactctaagctttcaagaaaatgctgtcacattgtttttatacctctttaagaaacaagatagtgcaaagcacttaagatttcctcttaaactggtagtttgaaaactcagagaaccaagcttcaataattctagcaacttcccttttgtaaggcgcctttattatctgcaagtcccagagaggaagtttttctgcacaacagcatattttacttggtggtggtttggtgaggcgttttggaggcctgtgtttccaacctccagccttcctttggagaaggaaatggcaacccactccagtactcttgcctggaaaatcccatggacggaggagcctggtaggcttcagtccatggggtcgcgaagagtcggacacgactgagcgacttcactttcacctttcactttgatgcattggagaaggaaatggcaacccactccagtgttcttgcctagagaatcccagggatgggggagcctggtgggcttccgtctatggggtcgcacagagtcggacacgactgaagcggcttagcagcagcagtggttccagcagagcccctgaggcaagcagagggatgtgaagatggccagtgtagcaggtccccagcccccatcccaacgttagccatgacaactccacttttaatatgttttctgatcatcaggtttctgtgtgttcatttaaacagaactctctgccctaaaaaggattgaaaagtaggccctctctgttacctagagtatagaagtatttggagcgctgggaaaaccctagacaggcattaatatggtaattactagctcatgtaactatttaaatttaattaaaatggagccttataaaagtcaagccttaagaaaatccatatatatatgaattccctggagttgggtgtggaaacgcttttggaacaagtggtaaatacattatgaagaaagacataacaaatggggcccaaattctaaaaacgtagaatatgtgctgcttttgcatggcccaccgatcacacgtccaagggtctctctgtctagccctatcctccagtccctggcacaatgaatgtaagtgggttgatttccctctggcgcctctgaagtcccaggggcgctgtcttagaatgcatgttgtgttgtgcagtgtgctgcctgtgctcatcgctcagtcacatccaactctttgtgacccaatggactgcagtccatcaagctcctatgtccatggaattttccaggcaagaatactggagcgtgttggggagtgctcatcacgctaatgcagttctttctttttctgttaggaatcagtctttgcacttgcatctcaagcactacggtgtgaattgtgacgactggttattacgcctcatgtgtgggggagtagaaatcagaacaatttatgctgctcataaacaggcaaaggcttgcctcatttccagactaagctgtgaacgagctgggaccaggtttaacgtccggggaacaaatgatgatggtcacgttgccaattttgtagaaacagaacaggtatatagtgttttatcttgcttaatcacaaagaacaattgcaaagcagatttttatttgattcagaactcattttgacatctgtaatgccattttatggttgctcttggctacttgtgagccttaagaaaggatcctcaaaaacaagcttatttaggtatggctcttcgagtaagtaacaatttgttactaatcagcatgacatcatcagtgccctatgttttagtattgaattgaaaatcttcagttacagagctagacaacttaagaaaagtgggttttaatgaaattaagtcaaactcaactcttaaaggtaggttgtgtaccatctgaaaggagaagttacattatttttggctataactatgtaattataaattcaggccttgccctcaatccagttcaagtcttcagattagtttttaaaaattagaaaaagctaaagaaaaataacaaaatgaattcaaaaggaatttcttttttaaaagttgtaatgcttatgcttatattttcactatcggttaatgtttgtagaactatcactagttgaaaaaaattcggcttatttatggcctattttgactattttgttaggataatttgtttatgagagactggtcaagagatataactgttagtagatttgtcttctgatgtagaggtaacaactttgtggaagtattttacccagtatttttctctgtaggttgtgtacttagatgactctgtttcttccttcatacaaatccggggatctgtcccattgttctgggagcagccaggattgcaggtatgtgttttgacatttagttttctttctttttctcttcagaacttttcatatttttttaaactttcaggttagcttattagttcctcggataattttgttactcagtctaataatgttacctggatttataaataaatagtatacagaaattgtttacaaatcctggaattgtcttagttattctttccttcagtgttctttcaaatatccataggagtgcagctcccatatttcatattaaaatttcaatgttttcatggcgtgttgattttcaaagtgtttctgtatttactatcttcgtatataacaatttagcatctgtaggcagaaaaatgtagtagttaaaacaaagcttctgaaactaagcctctcaatttgaatccttatactgctaggctgtgtgatctcaggcaagtgatttaaccccttagtgtccattttcttatctgtaacatggtaatattagtagttcctacttcttagtttcttacaacccttacctagttctgaccgccagaactaggtaagggttagctgaaatggcaccccactccagtattcttgtggggagaatcccagtccatgaggttgcaaagagttggacacagctgaatgtctgagcacgtttgttgttattaatatatctaggaatttcctggcatggcagtcagtggttaggactccatactttcactactgagggcccaggctagatccctggtaggggaactaagattctgcaagccatgcagtgtggccaaaaaaaaaagaggaacatatctgctgatgaaattttactttgcagtttgtaatgacttgggacttgtcatcttgaacattgttctctgttttgctttctgatcttttcccccccaaactttccttttgtttagtaaatgtctaatctttaaaatgtaagatgtttttttcacgttagttcataatattggattgcccatactagtgtgattttgcattttatttttattcaaacatgtttagtccctaaagtataagttacattcattttgggcttctgatatatactgcctagtaaattctgtgcctcagtctatactattgaaaaaaatatacaggaaaaagaaaattttgccttcatttactttcatttagttcacagctgggtctctcttacactctaggatggttattgtggagaaaaattgcacaccacttgaatcttttcaataagggagtttattcaagacaggctaagaattaacaaggattaacactggtgctgctttgctaaaattcttgagttcttgtcaacaccagtttgagtcatgtgggtttcatctttggcattttggcgtaacttatatagatatatttcttcctgtgtctcccttaggaaagaataccaaccctaccccatttctatttttgtgaccagagaagggtgtttggaatatttgctctaagaaatttctaaaaccctgctttgatgggaggtaaacgcttttggtttagagacaggctagtgtaagagattcttctagtctatttataggccctctgttttactgctttctgtgttattttcttaagttcagaattacagtgtttgattattcagtaatgttgggtcctgagtagttacatggagggatcctccttggatgggacttcctttcgacgtccttctttgttctgtggcctgtccacacagataatctgactggataatgtcatttgattatgggccgacaactgtagatttgaaaattgtgcctttcttgatagagatagtaatttttgagacctcaagacagtccaacagttctgccaaatcatcactgagctggcctgtcatcttgggttgggttgagggttgggtcagtggttctgaggtatttagcttagtagtttttaaagccaacctttctttgaccagagatggattagtttcatgagtatcttttatcattttccccaccactctaaaagagcagttaatagaggaatgaaaataatagatactgactttttgaaataaaaataccaaggccctaagttcatttttgacttcaagcggttgttgggtgtcctgagtgttcttagggctggaatttattttcagggctccttcaagttagtcacttagtgagctgtttcacttcagtggtcacggacagtgagtccttccttggcagttgtcccttgttctctctcttttcctccatgatacattcttctcaggttcttgagctattttaaaggaatctttgagagtgattttaaaatgcagattcatggcctcaacttcccatcaactgaagtagaatttgttggagtagggccaaggaatctgcatttcaaccaggtaccccaccactcagattagagagcttggcggtagtggatcctgctcagctgcttttgcagcgcatccagactgcctgctccagcggccaaccctgagccaagcaaggcagccctgtgatgcttaatcccagtgctgtctgaggtcttggacttttcttttcattcccacttctgtcatcttggttaaggtcttcatagttttttcttgcctgaaagattctcagatttctaactggtctcctcccatctttctgttgtctaaccaacgtattgctgtaagaattgtgaattgtaggtagttttatatatgtgttggggagcaagtaatagggaacaactacagccattaccaaaaaacaaatatgagaaagcttgtattttttttcaccttcttgacagttaagagtactagtgcaagatgaatgttaatgaataaacaaaatgcaaagtattggacttttagagagttagagggcaactacctgagatgactccagagaaaaagtatgaactttgtctgacgtttctgccgcctaaaatgcacaaacgtgtcttggagcacacacctttcaaagcttaagattttatacagtctattgtgtactaaaagtaaaatgaaataaagatgtgacatttggctaatcagtttcttactaagaaggaaaagctctaaagagagtccactgatttctcaggacagtcattcagtcatctcggcaggagagggaatgctgaatgaatgataatactgttaattcagtttgggacatggatgagcatttagagcttattttctggttttatttgtccaattgcatgactgatctggcacttctcctccatgccacctttaaagtcacattattcacagatgagccaggatgaattctggggaaccttgggcccacagtctcagggaggtatttacaagtgaaactcagggaaataatctggtctcactgttgtatttcttcttggcatcttttgtatctcttgattctgcctcatctctctcccacttttcctatatgagaaaagaaaaactgtagcaacacacagtaggtagttattttccatcttgtttaattcttataacccaaatttcaaaatatgctgttgttttagttgtgtgcctgagagattgacttggaaagtctttttccaggaatggttatgggatctttgggtgagagtggagtgaatagggtatttagcataacagagaaaaaaaatatgtagccattgcacttgtcggcagtctgaaagagtagatgttttggtcaggaggcctgtactgtcatgggaatcatttttcggaatgaatgatgttgctgtaagaggacaggtttcttcacttgactgggtttgttcttttgttgcacgaatgacaatatctgttgacttacaaagggcacatatttagaacgtaagacaaggtaatgtatatgaaagcactcttaaaaatatcttacataaataaaaattcctgtttttacagtttaccagtttaccagtgttgcataatgctctaacttctagttttttttttttttaatgaggttgtattttaaaagataaaaaggagaaacccctagaacttatttttttaagagaatatcacaaatgacaattactgagcttactactgtgtgcttagcaaatgaattattacatagagtaaacaatgctatttctttcgtctgcatgttggcttttggtacgattaagcatatttttcttatcttaggtgggatctcatcgtgtccgtatgtcaaggggatttgaagccaatgcacctgcttttgacaggtaagactgatgacttttatatattgctgtgagttttgatgttgctaagcagtgagattagttgtatttactgcttcatttcaccttttgggctcttaagtaaaatttcttcttgactctgatttaagtggaagacagtgacactcttaggaattctaggagtgatggcagtaagtgggtaggtcttgatgtcttggccttaaaactacctctgatgggtgtgttatccaatatggtggctattagctacgtgaagctagctcttgggcatttgaaattgactagtccagattgaaatatgttgtaggtatataataggtcctggatttcagacctagtgcaaaaaaaatgcaaaatgccaatatttgttttatatatcaattacatgaactaaaaagcctcttgatgaaagtgaaagtggagagtgaaaaagttggcttaaagctcaacattcagaaaacaaagatcatggcatccagtctcatcacttcatgggaaatagatggggaaacagtggaaacagtgtcagactttatttttttgggctccaaaatcactgcagatggtgactgcagccatgaaattaaaagacgcttactccttggaaggaaagttatgaccaacctagatagcatattgaaaagcagagacattactttgctaacaaaagtctgtctagtcaaggctatggttttttctctggtcatgtatggatgtgaaagttggactgtgaagaaggctgagtgctgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccccctcatgcgaagagttgactcattggaaaagactctgatgctgggagggattgagggcaggaggagaaggggacgacagaggatgagatggctggatggcatcactgactcaatggacgtgagtctgagtgaactccaggagttggtgatagacagggaagcctggcgtgctgtgattcatgaggtcgcaaagagtcggacacgactgagcgactgaactgaactgaacatgtagaaatgatactttagttgtattggattaaataaaatatatgtaaattaatttgaccttttggtttttacctttttaagttgccttctggaaaattttaaattatatctgtgacttacgttatatttcctgtggatgacattgctctctagcctctggactgattagaagctggagagactaaaggatcctctgtggggcctatttatcttaaggctggagctgttcaggagctctgaatccacacggagtaggcagtgtcctcacatgtgaggtgcagcctagtgccctctaccctcattgccttgccaacctagctgcatggctcctggtttccatgtccacccagcattagcctcagggtggagagggggccagatgactctgaaagccctagcatcagctcagtgcagttcagttgctcagtcgtgtccgactctttgcgactgcatggactgcagcacgccaggcctccctgttcatcactaactcctggagcttattcaaactcatgtccgttgagtcggtaatgccatcaaaccatctcatcttctgttgtccccttctgctcctaccttcaatcattccccacatcaggatcttttccagtgagtcagttctttgcatcaggtggccaaagtacaaggagtttcagcttcagcatcagtccttccaatgaatattcaggactgatctcctttaggatggactggttggatctccttgcagtccaagggactctcaagagactaatggaaaaaccaaagctttgactagacggacttttgttggcaaagtaatgtctctgctttttaatatactgtctaggttggtcataacttttcttccaaggaggaagcatcttttaatttcatggctgcagtcaaagtctgtcactgtttccattgttttcccatctatttgccatgaagtgatggcaaatagatgataagttgataagtcagagagaaaattgtattaactgacttttcacaaattcagagttttgattccacgtgaaatggatttgtatatagttttgccaatcctatgagtttaaaatactgccatgtaggtcctggttaaaagtgggttcctgtttattgaaaaaagtttttgacttatcacttgacatacgcttactgcctttctacctttaacaggcattttaggacacttaagaatttgtatggtaaacaaataatagtaaatctgcttggatctaaggaaggtgaacatatgctaagtaaggctttccaggtaagtgatcatttttttccttctgttctggcccatggacacctaggatagtattttaaaaataatagtcaaattcttccaggaataagttcttcctggaagaagattgaatacttgttggaaccattagttctttgaaggcaggtaggcaacaatttagggtaatcttgctgaaattgggattatagaacgcttttaaggcattgaccctgttttctaatctgcttatttatgtagtggagaagcagaagaataccctcctcctaaaaaatgttcatcagtcactggcagaaagataccaggcagtttcccccttcatctcttcattgctttggctagttcctacaaaccatagtcactgttttaaatctatgaaattgtgaataaagcatttgtatacacacaggacttcttgtaccaatgaaagaaaatttgagaatttcacataagtaagaacctaaagaaatgtctgacttctaaagaaaacatacttttcataaatatttattggatcaataatgaattgatataaattatagtgttatataaggttataaccttaaacaaaatggctagaaaacattttctcacgttaatgaagtccaggattaattatttggctattttgtttgaatatcattaataaacaagttatactttagagagtgactttttattataagcttttaaaacatttgtatatattgaatgaaggtataaaaatgaattcttcaaattttgatgagcttttccttagaagtcaattactttgttttgagattctataatagatatagtcattatatttttatggtaaaaaatgaaatgctggttgttggaaataacttttcattttctaaaccaaatgaaaatgtgaagttccctgatattaattatgtaagacctaactaatctatctggaatagtataggaggttttaggaaaaggatgctgtaagatattagcaagtaatttttcattttactgccaatggcaatgaaagaaagctttgtgaaattagtaagatttcaagaacctgcttagattttcatttaaaataaaagttccatttataacattgtgttgatacaatcatatttggttaacatttaaatgaatatttccatggtggctcaaacggtaaagagttcacctgcagtgcaggagacctggttcaatccctggatcggaaagttcccctggagaagggaatggctacccacttcagtattcttttctggagaattccatagacaggggagcctggcgggctacagtctatggggccgcaaagagtcagacacaactgagtgactaacactttcactttccttggcagtccagtgagtggttaagaatctgcagtttcactgcaaggggcgtgggtttgatccctgattgaggataggggagataggggatcctgcctgccggatctgtgatttgcagccaaaaaaaaaaaaccgaagaagaattaaatgaatattttatttttattttcagagtcatctgaaagcttctgaacatgctgctgatatccagatggtgaattttgactatcatcaaatggttaaaggaggaaaggcagaaaaattacatagtgttcttaaacctcaagtccagaagtttctggattatggaatttttcattttgatggaagtgaagttcaaaggtttgacttctctgtttttccttttttttaaattggaacttttctgtagttatttaatttctttattatacttgattttaagcttgttgttcttctttctaatagtagcttacattactgggcacgtgctatgtgtgggtcaggtagtgcacttagtctttacaattattaataacaactgtagggatgggtcacactggaggaagtggggggctgaaagctgtcatcttccccacgtcacgtaagtagaaagtgttagagctcgaattcatctagctccaaatctcatgctgctctttcggaggctgttccatttctctcgtaaaattaatgtcataatatttcttggcctcagtaaagattatttaatgcaaataaaagacatgggttattgtctgttctgctatagaactgcgtggttataaatctgaatgtgtgtttagctcctgactactggcctcattaaaaataagtggatgtggttgactggagagctagtaatagagagtggacggcaaaatgttaacgcttatagaatctggatggtgggtatatggatgatcactgtaaaattctttcatcttttttgtgtgtttgagaattatactagagaattgaagtggggagaaagtagatgctacattttaatcagcttaatttttctcagtttgttttagcttttgttattttggttttaaattgcccatttagtttcactgaatttgtttcaggtgccagagtggtacagttcgaacaaactgcttggattgtcttgacagaacaaatagtgtgcaggcattccttggtttagaggtaaaaaaatatgtgtatgtaacttaacgtcaaattcctttttcagtgcttttgtgatatttatgtttggcattaattatttttcacaaaatgaagttaagcttcattttcacaaataaagtttgacttctcttctagtttttttttttcaagtagtgtcccttttcatttaaatgtttcctttatctgttctaaatactttctttagatagcttctgtttccttttattgttcattaactttgcctccaaaaaaaaaaagcctgctgtttatactgttttagtaattgtctcgcctgcctgtcttttggataggcaaaatatatataatatatatatatatatatattattctcagtattgtaatttttaaaaaataattttatttatctatttttggctgtgctgtgttttcattgctgcgtgggctctttttctagttgtggcaagcaggggccactctgctgttgcggtgctgggcttctcattgcagtggcctcttgttgcggaacatgggttccagcgtgctcgggcatcagcagtcgcagctcccgggctctagagcacaggctcaatagttgtggcccaccagcttagttgctccgcagcatgtgggctcctcccagaccaggggttgaacccgtgcttcctgcgttggcaggtggattctctagcactgagccaccagggaaacccttgatactgtctttttaagaccttttggaattaaggaggatctattttcacatgtacaaccctatagaattatatttttaacaatctaaaccagtacagtttacatagcatttttttaaaaattgctacaaaaaccaggatcagttgaaaaatgtcattgttagaataaaactgaatgagagccaacttctctaacacactctttgtttaaaattttgtctttagtacttacctatcaaactcagtctaatttaggcataatctcaactatgtgacagactgtgtagcaatacttagatttcccaatcttgccccttatgcagctgtcagggtcataagactatggtgggtcttcatttagttctgtaggaacttagcatagttctccaatactgtaaaaccaggaatagaaagtaaaaggttcttatttcctctagcaaatgatcttaaatttggctagaatattggttaattagttactctgcagctgagattcattcagtctcaaaaggaaagtaccatgtatagaatttcctactagaaaaatgtatttttgatgtaactagattttactgctttgccttttttgaaatctgttgttgaggattatcattataatttagaaaatatgacagaagaaaagtgaaagcaggcatttgattactgtggattgagttttatgagatatcttgggtttatgttgagttctcttaagtggctaaagacatttagttagagtaagcttgtgaaacacttgaacatcttcactgaacatagaacaagtgttagttttcagaatctgtcttagtggactacccactgtttgttattaatattaggtgtgagagtacttactcccctagtagcttgactggttacaaaatatactgcaagtgtaagtaaaagcaaactgcttgtagtgaaaaccagttttgcccagttctttgaagaaagaggagatgataaaggagaacctggaggcttgtttgctttattctacatgccagcaaaagaacagccctggtgtaagtctaggcaataggattagacccagtatagagtttttaatattattttagtttttgatccctgtgtaattatggataatctccataatatctttatcttatagataagataaaaggaaacacaagtgggaaggagttaagtaaaactacaggggcatagactatgactggattccaaataagagaaatagactgggtaaggattatacattgctttgactttgccagactttaaggctaagagtcattcagagtaaagacttctaaacacatatactgtgatgaaggaactgtggtagccccaagatcctctcattcttcgaatactgtgttccccctagttctcccttatgtactttactgatacgaattcagtacattcagagctgtcatgactttattcagaaatatgacttatttaaaaattttgatatcaattcaagagcagctctgcttttttcataatctcctgaccttaattacccaaacatatagaaccaaatgcaaaaattaaagaaagttatttctatacatttttaaataaagtacgtatattcctctgctccagtgggtgctgttgcataattattcttttaggtgaacaagataaactagtctgatttataggaacttttttttttttttttttttcttattttggccccacagcttgtgggatcttagatccccaaccaggaattaaactcaggccttcggcagtgaaagcagggagtcctaaccactggactgccagggaattccctaaaggtttgggacattttaaaaagcttaatatcatttaaccagaaaaagttcttgttactacaaggattgaatactgtaggttgcattgatgtgatagttactttagaaattggcatgggggggaataacaaagcctagtaaacttgaattttcagaatccagacccacaacatcctgtaactataaatttttggtttgattctggtagttcttaaaaggtcacatcttaatggatgtatttatatacttataaaagtttcttttctgctattttagatgctgactaaacagttggaagctcttggtttagctgaaaagcctcagttggtgactcgctttcaagaagtttttcgatcaatgtggtctgtgaatggtgattcaatcagtaagatttatgcaggaactggagcccttgaaggaaaggctaaggtagatctagattataaaagatcctctttttttcttctttaataaagctttaaatgaactcttttaagttagtagttttttttaaggtatctattttagaattctgtttcatcatgtttttatgtcctgtttattacctccttctctagtggatactaatgactgaatggatagttatttccctaggtttgagaggtatattatatatgtatgacatatttagttgtttagtgataatctactaggcttacatacgtattacttacgatttttttaatgatttttcacttgcatatgtgttttaatttttatactgtttattttaatcagaaatatgtttttttttaagcctttgctttgccttttttatttattttttttggtcacacaaggcagcatgtggaccttagttccttggatcagggatcaaacccaggcccctgcagtgaaagtgcagagtcttaaccaccagactgctatggaattacccaaaatatgtttgtgtttttttaaattagggccgtctttggtggcccagtggttaagattccacgcttctagtgcagggggcgtggattcgatccttagttggggaactaagatcccacaggctgcgcagcacaaccataattaaaacaaaagttcccgcctccccaaatgttactcttgccaagaaagggtcttaccttacttgcctttgtgtccccagtgcttgccgcagcacatacagttggatagatgggtgacaagcgccggatggacagataaatcagtgggtactttatgcaacaccacctatgaacccagtgctatcagggctgaagtttttattctttttcttatcttaccttgacaaggaggctatcaaaatgtgcctttgcaagtgtgaggtgtggacgtaattatgtatctgtatgtcatcattactttaatttgttggtattatctacagactgcttctgctttagtgtttgtcccttactgagggactttgggtacatacttgaaatatttttcattatatccttaaatattgaccttttatggcttctggattcagctgaatttattaatgtactacaaccctacaatttctcaaattaccccaggaatagaaacagagacatttactacttgtatagtttcttacttagtctcttcagtatagcagctgaatttcatcatctcaagtcttctgttttccacttcttcctcttctgtgtctcataaaacgccatgcctctgttcagaagtattggccttagctgcaaagttccttttgttcaactcagaaataatttgtattgacatttacaaatatttacttcttaaatggtccctgttttgaaaaacctgatgttgttaaactttcatgtattcttttttaaataaacaacataattcttgcttttaaacctgattctctacaactattgcttaaaatattcttttatgttctgcctctttgtttctgcaattgactgtctatgtacagaggttacatatattttcagtgatcttttctaacaaactagatatgaaattttatgtattaaatatactagtctgaattgacctgaaatctaacatctgaactgctctttcttttcctttctctgggttccttttgattaattgcctgataatgtgaatggtgagtcccctttttaaaataatgttatttacatttgttttatggaaggaaataacatttttaagcctcaaatccttgttatttctttgaggaataaaaattacatattgcaaactaaagtttttttttaacttttttttaaacagtcatcaaaatctgtaagattaaaatatctttatggtaactaacacacctgagtgaagtaaacgttcactagaagttataatcagctctctcactgtaggaattggcatgcagtttatatttttatatttacataggcaaaatgagctaaaatagaaaactgtagtttctatgttacaggctagaccttcactctcatgctcagttttgtttctaactaatatcagttacttgggagcaatctcagttttattctctgctgttcgtgtgctttggagtttttctgagagtgcggacgtgcagtgtgtcctcctctatctcctctgcttctccccacccgccccgtccaccccaggcctgacagtcacaatgggagaagtgatctccttgccttgaggaagcacatttcagtctgtttcctctccagtaaacagttacacaggtttactgctctggatgtcatcagtggatgcagctgtggcactgagccccttctgtctccctgcagtgctgttatccaaaagaggaaaggaaacagtgacaccttaatgtgacattttaatgtgacagtttgatattcagaatggaatgatgaggtccttttactacagtgaagtcgtatacaacttatctaaagtttcagaatacctattgagtgaaaacaatgtagaatgaaagtccatgcttttttccccaacaggctggaaagttaaaagatggtgctcgttcagttagtagaacaattcagaataacttctttgacagctccaagcaagaagcaattgatgttttgctcctgggaaatactctaaatagtgatttagctgacaaagctcgagcccttttaactactggaagtttgcgtggtaggcgtactttatattttactttatgttgtctgtattccttctaaaagtccaagaggtgaatgtaaacttatttacatatatactttctagtttgaattgattaaaatagttttttgaaagaatttctatcattgtaattttctaaaattccattctccaaaggaagtttgattctcctaaaatatttatagcattagcagaattattaagctgtaaactgaagcccatgcatgttttcttttatagattatgattgagggggcaaatgatttaaatattgctaactttatttaaggcaagatttcataaaatattcaactagtactttcagtattcagtaacctagttatgtagaaagcattgctttattgaaaaaaaacaatacctgttctggttattttactaatcacaaccccagacgtttctataacttggtcttactttttaagtgctgctgtttgaataagctttaaatcatattaataattttaaaatgttgcttattattggacactgtcatccccaattttaatatttgacataaaatatatgccaggctttcagaatagctgttgatttttcactgtgtttctttaaaaccaaaagaatttgagctcatgtcagtgagcatattaagcaggatcatgggaaaactcagtatacattgtataacttattaaattagactcccttaatttttttttttttttctattttagctttccagcactctgaacatttttttttacttctgttatcccccaaaagaaccctttcagttttccctgttcaactaggagaaattgttcctcaaataacctcctcatgggttatcacttgttatcatggattctttcagaattctgcgtggtgctgaaggtagttaattacatgtcagctcctcagggatctgtgagtagactgggggactgaaatctactaaagctctgaacaccagaatctgatcatagctactgcttttaacttcaggctttcttccagcagtagacactgactcatttgcgtcttatcacctctttccacccgtgccttctttgatatggaggcattaatcagcaaccactgaaagtaagctattaaaggaaagagaagtgagggacctgaataattcccagacttgatcattagttttttagtttcctgcacattttactatgtgaagaacgtacccttaaaaaaacagtacagtcaattctgctatagctcttattttaagaatgagaatttattccaacggggatgctatgtcaggaaaaattgtgagtataacgccaattctgtagtagttcatgcatatttcactggtggtagtagtgctagagaaatgcagaaagctgtactcagcggaactgaggtggatagaaatatacaaaacacacatatacatgtgcatggacctctccctccctctgttcaccaactgtgtgatgagccagatcctcccatatctggtgtcacagcttactatctagtttcggagaagccttcttccagcattcacaattgctcacaagcacaggcatcttcctgctcatttataagcaaacctcaagtctttttcaagataaagtaccatatgttagacgtatttgtccattccttaaccgtttaacatgtgtagggttctgctactgtttttatagcaggttcctatcttggcacatcattgctgaagtgtttgaatgttgtgcccaaacccaaatatttttgccataaaccccatgcctgtgggaatttataccatcttgcatagctggtcattgtgttggaatgtatgtgtttttttaataactgaactgattgtacctgtcagctggtgagtcccaaaaaatactccaaggtgtgcattagggcagtatctgcaatatttcagtgtcctccagcctcttaggttttcaggttcgtattctcagaagtatgtgcacttgcacactcaacagacatacatatgggaccggcctggaaagcaggcctagaaccttctgattgtgaaactctgcacatcactatgtccccgtaggatttttcttagatacagtgggtttacatcagttattgtcatttattttatctttggtatccttcagccatcagaaaaaatgtcatcaaactaaatcaaaagaaaaaaatgaagctgtctgagaaggttttgtcataacactcgacttcaactgtaacttactgtgttactaatgactctttgttttcttcttgatgcatccgtagtttctgaacagacgttacagtcaggtacagtatagaaaatcaacctgtcaataaatgcaactttttctcaaattttttttaaaaagcggatgttgtatataaatagagccacaaataaatggaaactttatttttccctctgattctgacaggataaattgatgctttgttttaatctaagaaaaagaattttaagtttgagaaaacagactacttcatttagaaggagctatgccaagctctttgtcttcttgtagcaagtgcttaatttcaattaaatatgggtcatctagttttaattttacttttacatttcagtgaacaaacattattagtgttatattttaccctttattgttgtttagtcactaagtcatgtctgactcctttgcgaccccatggaccatagcccaccacgttcttctgtccatggaatttctcaggcaagaatattggagtgtgttgccatgtcctcctccaggggatttcccagctcgggggttgaacctgcatatcctgcgttgtcaggaggattctttaccactgagccaacagggaagtcctgaaaaaaacctagatgtgactcttacagattaatgggaaatactacctatgatgtttacaactactcaatagcacttgtcacacacataacattttaaaaaagacattgactcattttctcatatggtgtgtgaaatattttctgaaactggaagacctgcactaaaatatgatctgaaatcttttaaaaagcattaagattgctagcaaagttagaagagccaagtgtgtaagacctaaaggtcttatttttcttgtcattccagttcttaaaaatctcataccttcattctctggacaaggtttatgatcttgtctttaaacttgagtctgtggcaaaaggaactcttgccagaaactttgctgaaaagacatcttttcttcccttcacttaagatttggtatcacttaagatttttgtttcacttagttatttttctgagtgttttaagacactgtaggtaagtttttgagaagatggaggaagagagcacttgtatttatttttgaattaacatcatgaaatccgttttctgaaatgatatgatatttaggaatggacatctgtttgaacagagacacatttctttctgcacattaaggtgccaaccagtttttttaaaaaagaataaactaggaattttaaaactttttattcccatttataaactgactttagtagcttactcaatgtggtacatggttttcttcacacaattcattgtatgtcttgctgcatattttaagccattaaataattatagagcttgtgttttcatgtagaaaggattgtagaagctgttttcatagtagtaacactgtcagtgacttcgattagaaagaccagtgttgatcagtagtaatagagaaggattctttatccaagttcagccaacattcagttaaccatatcaacaggccagaaaaacaatctgctttcattccccccagactcggtgcaagtaatcagataacagactcagagatgtatacatgtgccctaggaacagtgaggatgtgcttgtcacctgaacctgcagttcttttgtaggattcacaagtcagactgttttcattctaatccaaaaatgttatcagcctttttcactcattctttcacaagcttgcttgctgtaccttggtatccattccaaaaataataattaatatcataataaaataagatcacctggtgagaggtgaagatcattttgatttccgtctcctcttggcagttaaccacccttttaagggcatattctttatcattattaatggattgaagtcctaggaagtttctattcactttaagtgccaggatttgacttaatctaagtgaaatgtggtttagaaggcagaaagttaggtggaagccaaaaagtaggtggagaagagagattgaggattcaaaatgtatttcatgtttattcatttaaccattgtttactgaacgctcagtatgtaccgggagaaggcagtggcaccccactccagtactcttgcctggaaaatcccatggacagaggagcctggtaggctgcagtccgtggggttgctaagagtcggacacaactgagcgacttccctttcacttttcactttcatgcattggaggaggaaatggcaacccactccagtgttcttgcctggagaatcccagggacggtggggcctggtgggctgccgtctatggggtcacagagtcggacatgactgaagtgacttagcagcaagcagcagcagtatgtaccaggtgctcttctagtctggagatattggagcaaataaaatagaccaaaacttctatatagcacagggaacttgacttaatgatctgtggtggctcaaatgggaaggaaatccaaaaaagaggggatgtatgtatacatgtagccgattccctttgctgtagagcagaaacggacacaacattatatagcgactatcggggcttcctgtgtggtgcagcagtaaagaattcacctgccattgcagggggcacaagagacacgggttcgatccctaggtgagaagatcccctggaggagtaagtggcaatgcgctccagtattctgcctggaaaattccatgggcagaggatcctggtgggctatggttgaaaagagtcagacgtgactgagcacatacactcacacatcccaataaataaataaaatgaaaggatattcattctgtatgtgttagtcactcagtcatgttctactttgtgccccatggactgtagccctccaggctcctctgtctgtggaattctccaggcaagaatactagagtgagttgccatttcctactccaggggattttcatgacctagggattgtacccgggtctcctacatcgcaggcagattctttactgtctgagccacagaactatcatattatcaagcatatctacttctggatatatatttgcatactgaagtgggtagccattcccttttccaggggatcttcttgatccagggatcaaacccaggtctcctgcattgcaagcagattcttttaccatctgagctaccagggaagctccattcattctggttcccctgcacaaaaaatgaaaatgagatcaaccaacatttctgcccttgtggaacttccattttcggtgaggggtgacagttaacaggataaataaataaaatgcatagtttgtacatggtaataaataaacaccatagagaaaagtaaagcagggaggtgatatggacagtaagagacagaatgcacattttaataagctgatcaggaaaagcctcacggcagagttgatgcctgcaagcggtgagggaatagtgttgcgagcagtggaagcagccagtgcagagggggtccagggccagagcggtgagcgaacaaggtgggatggcagctgagggtagagaggcagggcaggttgtctggggtcttgtagaacattggtgaagacggtgtcgcctgtgatctgggaggcttttagtaatggcttcattctccagcatctcattattgtccatgatttgcgtttgtgtcagggagctgtttttcatcaagctacctgtgagtagttagagtcctatatgtcatggttcttgaacatctttctttggggaaaaataacttatttttactagcttccgaatgaaagttgtctgtaagtcagttgctatattccttaaaatttgcagtctctgattttgtgtatcataaaatgatgtactacttcactgaaacagaactgttttgcatgttttatgttgctgaattaattttgtaatagttttttttacttgggctgttgtacttcacgtagttgatattttcaaagtgtgttggttacttgcattgtgttgggctctgtgttcaaggcttatctcttttgtgcctgtgcatgtatttgatgcttgtttgtgccaatgatggtaattgtactttctagccatcatctctcagttatgaagatcaatttttgtaaatgttttcacgcacccaaaattttgttgtattttgtttttaccagcatcttctaaagtactaaagagtatgtgtgagaatttctacaagtattcaaagcccaagaaaattcgagtatgtgtgggcacatggaacgtgaatggcgggaagcagtttcgcagcatagcttttaagaatcagacccttacggactggcttcttgatgcccccaagttagctggcatccaggagtttcaaggttggcttcttacaatatggattaattaaccctgactctgatgtattaacctagaaaacaaatgcggcgcttcacaatatgcagtactttataaaagaaacttctatatatacatttgaagcccagcattcttcttagagatcaaatctcttcaaatcttaggtcttctgtattcatagacctttctctactacttcataggaacctatggtaaagtgagaaatctttttgttatttgattctcagacaatgtaatccatacatgagtagataactcttttgtgtgtgggtttgtgtatttatttttttaagatgtgattttttttctcctgtttttattctttaaactgatgcatagcaaatttattttgtgattaagaatttttcaaacctaatgtattttgtttttcaaatagagccctttatttgctaagataagaaatagggtaggtcatgagtaggtttacaaaactcattttgacatttattgtccctgtaacagaacaatactgattcatccttgtaaaaactcatcactgagtttgggtactctaccaccaagctcttaatagccagtacttaagctgaggatgcttgtattaagatttttaactagaatcatggatttgaggactgtttgcttcaacttgaattcctttttaaaatggtacacatttaccaagtgttatttatgaaggagatatgtataggaaatactgtgagatacagatttttcttttttagttgcctttaatcagtcacaccttaaaccctgggaatttccctaaacttttactaaaatgctgcttttcattttacattgaacctaacttgaaattgtagctgtagtattaatagtaataacaataataaagtaacagctaacactactattatgagtacttgacatctattcatttaatcattataacagacctaatacatagccactcttagtatttcagtttttagatgaggaaactgagacacaggaagagaagtgacacgcccaacgtcatgcagctggcagtgacagagccaggatttagggatggacatctggcagtttgattctggagttgtgccgcactgcactttgtgtgtgaacttgggcaagttgcttagattttccagagcctcagtttcctgtctgtaaataacaggcagatgtaatctgtctcgtaaggtgtctgtagtaaaagagaagattcacaggtaagccttgcacacaatagcagtcagtgaatactttacattttttattcctcagtatttgttcatagtatttatataagctctttctcttagctatttgtcccgtttctgaatgcttgggccacccaggctaccctgggcttgcttatctaaagcagttctgttctcttttggtaagccatgggagagctaatggctagaagagaggggtctgaagccctgacttcccattttcctggattgcttccacctaggaatttccaaattaaagtgtaaaattccctctcagctgtttgctctaatttgagttggttactcgcccaccttattgtttgtgctctttctgaaaaatttcttggtggctaaaaaaggaggggatttatgtatacttagggttgattcatgttgttgtacagcagaaaccaatacaacattgtaaagcaattatcctccaattaaaaataaataatttaaaaaaattttaagtaattacttatccatttggattcatcttttagcctctgagaagcggcttgtttctctgctgtccatggttcaaaccataacaacagttctttcaaaaatgatttctgaaaggacttatcttcaagaataatagtcttcaagaaaagcaaacttaggtcacctaaatagaaattgaaagtaattttgtccccctcatggttttttgcctttaatttgcttttggttaaacttggaacacaaaaatggacttgtatgagatctgatgttcgtcttagttctgttggggtagggaagttgccgtttaactaaggccatcttttaaaaggctttcttggatgcttaattttagataaaagaagtaaaccaatggatatatttgcaattggttttgaggaaatggtagagctgaatgctggaaacattgtgaatgcaaggtaagccagccaggtaacacacagggaaactttctagttgatgaacatgggggacaggtaactaagtacttactacaagcatagatagagataatatatgtgaaggtgctttttaaactgtaattcaaataatagttctcaaactttttggtttcaggtctttctacactcttaaaaatgttgaagatcttaaagaacttttatttatgtggttttatctcttgatacgtatcacattagaaattagagacaaaaatttttaagcattcagttcatttaaaaataataactcattacatgttaacataagtaacacattttttttctgaaaagtaactattttccaaaacaaaaatttactaagaaggatggcatcaattgatagcttgcaaatctgtttagtctggtttaagatggctgggttctcacatctacctctgcattagtctgtgtagtgtgttgttttgattgaaatatatgaagaaaatcacataaatacgtagttggaaaccaaaatattttagtagcctttttagattttttcttctctgataatactcagcaaatagtcatttttggtggttagttacagtgtggaatctgaaaccatagtgatgaactttttgtgctcaattataccaaaacatcggtctgtcttttacccgtgcgtgattttgacacgtcattcattaggcatttggaacatagtagtagtaaactaattatgtagatctttcagaattatgtagatctttcagattttgatacatgtcattgtataatatcaaaacataatattggttaatttcatcaccaaattaatttaatctcttcagcaaattcttcaactattgggaagctgtcaagatcatagtagcaaatacaggtttatcaaaattcccccttttctttcaaaatgtaaattttattattagaaatatacaccataggtcatgtcctttgaaaacacaggcatggttgaaaacatgtttgccggatagtctaaatttgaataatcatagtgtgtctgtcactagttcttccaagtaaaaattgtattctataaaaaaagtggcatttcagctctgacctcagacttgagtgcttttttctgaaacagccatcatgtatgtgttcagtgtgcagcaaaagtggttggtttgtatttttccattcattacacagaatataaaaagatgggcttctaggattgagctttgacaaaattagtaatgtttactgcttcatcaggatgttcttaggtgaaatggctatttttgcttggtgttggaggttcttgggatttccctgttggctcagacggtaaagaatctgcctgcaatgcaggagacccaggtttgatccctggtttgagaagatcctttggagaagggaatggcaacccattccagtatttttgcctgggaatttccatggacagaggagcctggagggctgcagtccatggagtcacaaagagtaggacgcatcttgggcacaaacctattactctgaaaatgtataaagagaaagacaagcattttccctaccttctttgtataaacatgtttcataataactggatagttgataaaagttctttacagaagaattccaattcattacaaatgcccatggaatgctgaatttatgaaatcaacatgttgtaacctctgttggtggagaaggaaatggcaacccactccagtattcatgcctggagaatcccatggacagaggagcctggcagattatggtccattgggtagcagagagtcagacacggttgaagcaacttagcttggaacccctgttgataatggatctaggcaatgatcatcagttgatgttaaaaccttatagaaggatcagtggaggaacttctttataatgagttaattgtcacagtctgaacagcctattagatataatatctcagagattacatgcttcctgctgtgatgcaaggctgattataccaccatgaggttatttttgccaaaacaaatcaataaaattgaatcatgcttctttaattaccagtttaaaacaaagctgacagaagtgcaaagtatcatgaagacacgtcaggcaaatctggactgttaaacgtcctgcagacaaataacccagcttcttaaaacataaagagcattaaaaaagaggatggggcaagctgagagaccgttaaagactgagaaagacttgaggaggcaacaagcacatgcagtgtgtagaccttatttggaccttgttttaaagaaacctactataagaaactttttttttagataacaggaaaatgtgaatatgaactcagtattatatgatattgaggaactgttaatatctaagtgtgataatgaccttttgattacagaaaaataaaaatcctgttgcattagtgatgcttagtaaagcatttttgggtaaaatggataatttttcctcaaatttgttgtaaaatattccaagattagagaaaggggtggggagttatggaagaagaaagattggcaaaatgtggataattgttgaagctggttaatgggtatatggtggtttattttatgcttatcttttttgaatatgtttaaaattttccataataagtttttaaagagatattataatccatggaaataagaaaaaggggaaaattgcatctggaagcatgttcttccctgttatcctaatgaataaataaggagaaaataaagcgtacaagcttgagattacttacacagtgagcacttatttaataagaaagctcaaattttctttgtaagggagtcataggataggcttttgacgtgtgatgttcttttggctcagttttctgttttccttttttaaaggagacaaaaacacccagcccgcataaagatttcactgttggtgtggatttcgtgatgtcactaattttattaaatttgggcacataaaggtgtaattgataattgtcctacagaaataggctgtattactgtcaccgtctttttgaagattcccttgttaatattttctggtagcacaacaaatcagaagctctgggctgcggaacttcagaagaccatctccagagacaacaagtatgtgctgctggcctctgagcagttggtgggcgtctgtctgtttgtttttatcagaccacagcacgctcccttcatcaggtgagtagacagatggcgctccgaaggctgcctcctaacaccagataaccaaaaggcctggcgtatttttggcttcagagaaacactgacgcatggttcttgtttctgagtgttctttttttttttttttaattgaagtgtagttgatttatatggacttcccaggtggctcagtggtaaagaatccacctgctaatgcaggagacacaggagacaggggttcagtccctgggtcaggaagatcctctggagaaggaaatgataacccactccagtattctttcttgggaaattccatggacagaggagcctggcgggctacagtccatggggtcgcaaagagtcggacatgactgtgcatgaacatgcatgatgggtgatagttgatttaaatagtgttagtttcaagtatacaacaaagtgatcagttatacacttgtgtgtgtgtgtgtctatctttttaagattattttcccttataggttattacaaaaaaataagtatagttctctgtgctatatagtaggtctttgttggttatccattctatatgccctctcactcgcgccttccctttggtaaccgtaagtttgttttctgtgtctgtgggtctgtttctgtcttgtaaataagttcgtctgtatcgctaagtagtattccattgtatttacgtaccacatcttctttattcattcatctgtcagcagacatctaagttgtttccatgtcttgatattgtgaatggtgctgcagtgaacattggggtgcatgtgttttttcaaattatagttttctccagatatatccccaggagtggaacccctgtatcatgtggtaactcttgtttaaatatgttcttgattaaagaattgctagtagtttctctccactatttcacaggcttccctacaaaatgcccatgatgtatagtgttgtaattatgtaatagacattcttcatttcttacacacgcagaactgttgaaatttctgatcttggatttcaaattcttccttttaaagggatgttgcagttgatactgtgaaaactggaatgggaggcgcaactggaaataagggagcagttgcaatacgaatgctgttccacaccacaagcctctgctttgtctgcagccacttcgctgcgggacaatcccaagtcaaagaacgaaatgatgattttgtagaaatagcgcggaagttgagttttccaatggtaaactcttgctacttgttttcgaaaaggaagctttggaacatatttcagttcaccccatattctatatcagtttttgaaaagttggaataactcctagaaatgtcagcaaatagataactccttgtgttattactgtggggttaaataaatcgaacctggcaggggtaaggcaaagaaaaagttgtaaaacattttgtgaattgattgtttggaattctgtctctcttcttccagggaaggctgctcttctcccatgactatgtgttttggtgtggcgatttcaactaccgaatcgatctccctaatgaggaagtgaaagagcttatcagacagcaaaactgggattctcttatcgcaggagatcagcttatcaatcagaaaaatgctggacaggtatagacatacctaagatacttgcattgggaagaaggggatgtctgattatgaaaacatgctttccctaaagttttttttttttttttttaacaatctcttggagtctatacttaataagtatgtgctaagttacttcagtcacgtccttcttgttgtgacgctaggaatgtagcccaccaggctcctctgtccatgggattctccaggcaagaatgctcgagtggattgtcatgcccttctcctggggattttccagacccagaggtcaaacctgggtctgttatgtttcctgcattggctgatgggttcttcacactagcaccactcaggaagcctttactaagtatatatatctatagtttgccttctctttttaaaaaaaggaaaaggaaaggaaaacttataataatttccaggaggaaaagtatatcatgtctctataaaattcaccttcaagtagaagaagattctttttttctttcagcagtagcaaatttaagatcttactcatcaaggctactgctgtttggctcataagatcctatggtaatctactttcattttttgttacttatttatggccatgctgtgtgatatgtgggatcttagttccctgaccagggatcgaacctgcaccttgccctgcattggaagcgcaggctcttaaccactggactaccagagaagtccttggaagaatttattttaaaaaaatttttaggaagaggtgattgaggccacttgatatagtacctttctgatcatcagacttaaattctgatggataccatgtaaccttcttaggccccagttcctgttgagaataagacatcacacaatgtgatttccaaaatcccatacagttctaaacgtttgatactgctcaaaagtctggtggaagttcatcgttccagtttttgtactttgtttactcagacatcaagtgagtgagatgataaagcccgcatcctaggtcattttgccttaagctctgttccattcagttagaagtgttcctcagaggcacatagatttcacgagtctctagcacataatagacatttagtgcatgactgcccgaatgaaaacagaatgtttttgcctttttgaaataacttcctttatgtatgtttattttagatttttagaggatttttagaaggaaaagtgacctttgctccaacgtataaatacgacttgttttctgatgactacgacactagtgaaaagtgccgcacccctgcatggacagaccgtgtcctctggagaagacggaagtggccttttgatagatcaggtggacatcgtcatttaaataagtcaatgcaaattttacaaggaagaggggaatgatataaatgccaaataaggccaagaggactacattttttttttctcagcataggttatctagaataaaataaatataattcaaatataaaacttaaaaaaattctcagacctgcttataataaacactttgatttttcaatctgttttctttcagtgaaatagtgtcatataaagaaaagcaaggaaaaacatttttatgcaattaacaactgaatactaagtaagatttctaactggaataactcaagtggttttgcaaatattttgaactgctacttgtctgttcagttatttgtaaaactctggtcatgaagtctcagaagtaaaggctcattgtagttttaactaagtaaagcataatatgatgacctcaccaaaaaaccctgacttaacagagtctagacttcatgcccatcagcaagtgtgtctgatgtcccagcctcaggcaactgaagctagtgaaatgaaggatctcctgtggtctgtcatgctcaggtgacttcgcctgtgttctgttttattctgactgcagctgaagatttagatctcctaaatgctagttttcaagatgaaagcaaaatcctctacacatggactcctggcactttgctgcactacggaagggctgagctgaagacttctgaccataggtttaagcaatctctgtatttctaatcatgcttgaaatttatttgaaatacatcatttctgtaatgttcctaacatgtctccattccttcatgctgaaggcctgttgttgccctgatcgatattgatatatttgaagttgaagctgaagagaggcaaaacatttataaagaagtaattgcagttcagggtccaccagatggtacggtgttggtctcaatcaaaagctctttaccagaaaataattttttcaacgatgctttgattgatgagcttttacagcagtttacaaatttcggtgaagttatactcataaggtgagtaacgtaaaaaaaaaaagcaactcatgattcacaaataatatcttctgtattaaaagttacctttcttagtatttgactagtatgtgagtatttgtggaaattccctggtagctcagtcagtaaagaatctgcttgcagcgccagagacctggcttcagtccctgggttgggaagatcccctggacaaggaaatggcaaccctctccagtattcttgcctggaaaatcccatggacagaggaacctggcgggctaagtccatgggattgcaatagtcagacatgatttagcaagtaaaccaccgtgaatatttgtatcttcaaactaaaagaaaatcatgctatagaaatattattcaaaaaacccatgggttttgaaactggactctctgcttagaaaatttaaagttgagtagtgaaacttcacgtgaacatctgatgacaaaaatacgtgcacatttagatatgttctctccagatttctgtacactataacatggaagccctgtggaaaagtgaacatgtgatattagtattttagttttttgaggagtgatagaagtaaagcagaatgacttttctgccctccatttaagacattagatgttctcagtaattttaagtgatttgatttccgtctgatggaggagcggcgctgcccggcacacagttaggagtcatccttccctgccttggtttccggcactgacttaaccatctgccttttgcagaaccagatgcctcttgcgttgttgaaataaatgttctcttcccagtgtacagcagttttgacaaactgaataacatgtgtttgaatttcatagggaagaggtactattaaattcctttctgtgctgtttcatgtgtttattgagggatgtttcatagctgtttagtgggcaagtctctatactgggtgctctggcagacaggggaggaatcgaagattcagttcctattcggaatctaagaaagataagcgtgtgtgtaatggcttccttaggtgtttaccggaacagcccacagaatgaagatggcttggtttcttgcagggtgagaagcttgcctgagaagcctcctctcctttctgagagtaaatgggcaaatagagaagaaattatatttagacttacctcaaattgtttgacaaagatctaccctacaggtttaaaatgaaacaaaaaacctctagagatttaagactccagcaagtacatggtgaaatttcccaatgacagtaagcgttgccaagtacagaaacaccgaaccactgggagcatcatgtggactgtgtgagtgggcagcacagagcagttaagtgttcttgcgagcaagtgtgaactcttgctcagagtttacaatactttttccaatgataacaagcattttggggaaagcttttggttgcaatttaacactgtcaggggagtgggtaattttccttggttctatttcgacacaacaaaaatttgaggcgacggatattaaagcccttggcgcatcacagctctcggatagtattacagctcccttggttttatttagaaaataaaggaagatacatccttgaggcatgagggcatgccaacgcaaaagacaggacgagaaaagagaaagcgagcactctctctgggtgagagagaacccatagtgtacataaggaaggaacgactgacgcagggataggaccttcctgccttttttctagtctctaaagagcttggtgttattaggtagttaagaataggaaaaaggagtccagaatgatggtgattaaaagacaagggaaaagctcttgaaaataggacagaagaaggtctgaggaccggagtgaggacctcaggtagaacaaacagcactcctggctagccccgtttacgtagggcaggcccagagggagaaaaaaacatataaaaagaggagccaaagggctgggggtctctcccacgcgtgcacgctcattgtctctctctgtctcccacgcttgctcgctctcttttctcatcccgtcttttgggtcgggtcagcatgccctcatgcctcgaggttgtatcttcctttattttctaaataaaactgtgggagctgtaacactgtctgagatctgtgatgtgccaagggctttaacgtccatcacctcaaatttttgttgtgtcgagacagaaccgaggaaaattacccactcccctgacagtattaaattgcaaccaaaagctttccccaaaatgcttgttattattggaaaaagtattggtaacagaacaagtactggtaacaaaacaagggtaatgttatgctgacgttataaaaccatgtggtacctcctaacctagaatattctgattgttccaccttaagaccaccaaggtagaacagacaggggagacactgaaagtaaagaaggacaggaatactgtcccctgtcacctgtaggctaaactgatcatcaccttcagctctagaataagccaactgttagggaatgactgaagtcatcatatgtaaattatatgtaaataagagatttcctgtaaatgtagatggggcaggctacttatattaattgggggggaagtttagaatgcttctatcctattgagtaaaaataggaaaaaagtacaacacacatttggagttccgcaggcccattccttctgacagacagttttagtaacactgtattgggttgacaaaaaacatcgtttgggtttctccataccttccaaggggggaacctgaactttttggccaacccagtatctaaaggaatttgaatgcttttagggaaagagagccctctcctggtcaccgctggccctgccgctctcaggcttgtatttttgtttcctagcctctgtaagtccttgctcatcagtaatcattggacgagtctttgggctggttatatctgaggtattcattacgtttttttattgtttgtttttctcttccttaaagatttgtggaagataaaatgtgggttacgtttttagagggaagctctgccttgaatgttctgaacctgaatgggaaagaggtaaagtagcatttgttgaatctaaaccattcagtgatttagtgtctgaggactgtatttttaagatacatgcagcaaattatctaaacgtgtttcgaatatctagttgcatgatgcctcggattacctaacatccaacatcctaattattttttaactttgacaatctgaaaaactagaagtagtatgtcacgtctgtgttaagatttcaatggagagtttttcaattaactggtcgtttcatacttctctggcaagctgtttatgacctcagcctgtgttcccctcggggtattcatcttttgaagcttccctgatgttaattccttttcataatgtgctgtacatgttcttcccagttcgtcttgtgactttgttgttttcaccgtatagaaattactgatttttaaatttaattctgcctttaatatcttaagcttttcctcctcccatgatgtcattaatatttaagagcagctctcaatttggcatcccttgtcagctcttactccttttttgaatatttcttttgtctttcccctggtcattttccttgtttagtttttttcctcccttctttttcagctctgtccctcaccctcaagtctgtgttacacttctagaaagtgcccacccttagctcccttaaaagattttcaaaattctgaaaaaataatgtttctggagaacattttgaaagtcagacgtgtccaaacctctcctctgtctttgttattacagttgtttcagcccagatcttctagatacaagtagatcgataggaactcttccatttcaggggagaatctggaaaaagtacagtgtaagcagagcaaacttaaaggataacctgcttgagcatttttttttccagcatctaaatttcttccttttcattcagttctgatctctgccaagtgaatattcttgatgaagtacatcttaagtggccattgtagtgattgaggcttaagaagacttgttagtattctttggtgaatgcataacaaaggttgttgacttaaaaaaataaatggtccatgaagcctattgacttaaaaaaataaatggtccagaatcctagttctgacttcaaacctcagcatggacgctaaattcctattaaacacgactgtactgttcaggccggcagctgtcagcctttcagactgtgccatgaaagaattctgatgtcagtagcatttaaggaaagtatttttaatatgacaggacaatgtaagttgattataatacattgattattttagactatacttttgtctaaaagctcctcaactttttaggaacagcagtgtgccagtttcacagataccagtccttgtgttttcagaatggttaatttttgttgatttaaaatgatcttagattctcttaagtatgcttgtgacatttgaaatgctgaaaagtctaaatgaacaggaaagtattttaagaattttatactgtcctttctttgattgtctcatgtggattaattaattaatttaattaattaatctgtggatcaaaattaaaggaagtataaatttatgtagcagagttttcagtgaatttagatctggcccgggaaagatatttactgcagcaaagaaaacttaaatttgtgtgcatcctagaaaagaagacctgagcttagcagcagtaggctgttttgttttggccacactgtgtggccaaatctcagttctgaggtcgaggattaaacctggaccatggcagtgatggcatcaccagctcaagggtcatgagtttgagcaaactccgagagacagtgaaggacagaagagcctggcatgctgcagtctatagggtcgcaaagagatgcatatgacttagcaactgaacaacagcaatgacagtgaaagcctggagtcctaaccactaggccaccaggaagctccctaacaggtttttaaagggaggattggggacatttgaaactaggtgacaatacaatatatgtgaaatgattgtgttgaatgaatctgagttaagcctatactattgttataacttaaacagacactttattccaagatacttaattttcatgccaatgaatttttaattttgtatctcttttactcaaccagttactgggtaggacaataacaattactttaaaaagtccagactggatcaaaactttggaagaagaaatgagcttagagaaaatcaacgtccccttgccatcatcaaccagctccaccctcctaggtgaagacgcggaggtcacggccgacttcgatatggaaggtctgctcatggagcacattgacttctatccttctagacaggtttccttcccatcagcaaagtctcagtctccaaatctgtccttctgtttcttcttgtaacactcagagaagtattaatcagatttggtttacattgtattgtgtgttttttgcttgttacacagacttcagatgtgtgtgcccttctgccatacaaaggtcaagacctttacaatagttagtttatgtccttgtgtgataaaagcaggaagtggtatttttggtgtgtggtttggttccactgattgtagttaaagtagaagagtaggagttctgtgcagaaatgagttcaaaatatttacaaccaaagaggatatatttcaaagtcattttaaaaattcttaaagtggctgggaacacatttgaaactgaacccactcatgtagatgtaatcatctcaagtttaagagtgggccaggttatcttaatataataatttccttaaatgtgattaagaaatgtatttgctttttaatgctgtatctgctatattattttaacatattttccactaaaatgcataccttagtttataaaagggcaatatatcatattgtgatatcctgtacctctaggtaacacatttaagagttgaacaccttagaagatcagcttgttttcatatttctctgttaatttgtttgcttggtccacacgtttatgcacttaccttttatgtgccagttacatgctaagtgctggaaattcaacagatggcatccttgccgtccctgaagtcacagctcagtgggtgttacctacaagtaggcagacggtgacatcaacacactcgtgaacggtgctgctgtagttcttgggcctaacttagagttggacagttaggagaatgtacccagagaaattgaaactgaaaatctgaagactgagtgagaatcagattaaagaggatagagagacatcaccaggaagaaggaatgtgcagagacctaaggggacaaaaggatctaagtagatgatgcagatgtgcttgtgcaagaggaagggaagaaagaacaagaagaggagtgggtgtggatggaaggtgaatttcttttctgttttgtttgaagtgtttgtttatttggctgcactgggtcttagttgcagcatgcaggatctttagcatgcagacccttagttgtgacatgtgggatctggttccctgaccaggaatcgaacctgggcccgctgcattgggagcacggagtcttagccactggaccagcagggaatcctgagtttggttttgaatgtgttgaagttgtggcatctgtggggtgcattgggtccagaagtaagctgtgggcatgtgggcctggcactcagcagagagcccggagctttgatgataggtaaggccctgcatttggatttgcttggccagaaacctgatagagatgggagaggacttcctgggatggaactgaaacgcagactttgaaggacaggcagaagaaggccgcccataaaaggaaaagcagaagaaacgactagaaatgtcagagagccaggagaatatagtgcttaaagaccaagtgaagaaaagatgataaggaaaaatgatctatagcgtcctctgtcgcagggcgagaagaagtgagcgccacagcttgccctttgggcttggaaccaggggaggaagctgttggtgacattcaggagagtgatttcagtggagtgaagaagccagatggtggtaaatcggggtgtggatggaagacgaggaagtgcagaaagtgtctgtagacaactctcgacagaagtgtgcctgagacgggagaaagagagatgaaggcagttgctccctgaagtgttgttttgaagtggagacacttgaggagcttaatcctgatggaaagggctgatgctgctggggaggggcagggcaacctgcactgggcagaaccccaccctttccacccatagatatggttaggctacagctggggggcagattgttgaagaaaggggttcccaccttagaacttccttttctctgcgaagtttaaggaggcgggcagcacacggtttcaggaaggttgagaaggttcaagacaaagctcctgagaagcagtcagatggggagccagccaggaaactgtgggttggccaggaggccatgggagcccagatgaggctgaaaccacaagttaacacgtgcagtctttaagaccacacggttatctgtctgcagcacccagccgcccgtctgcggttatggagacattagactgcagaattgacgcaggggcaacggaagaatagtgcaggaggggaccagctgcggcaaggagccagaggatgtgaagacagctgcagggacaggtgcaaaatccagtaggggcccaaagaagagggatcgaaggcttgggtcctggtgaagtcagaagaggggaaagagtagccaagggcaagactgagcctggaaggcggtcagagggaagtgtttgagtttattgtttcagaggcactgcggttccaaggggcatgagtgtggagtagaggagcgcatcagcagggaaaagtgtcaggttgttggtgtgttatccacagtggcttcagtgtcacccagaaagatggcggggcccagcttactgtcttgctctctccttggtcctcgatgaatgggttcaagtgaccaaaaaggtgaaggtgggagattatggcggcaaacgtgggttgagggcgttacataaattctggaaggcacagcttccagaaataaagaggcctttttgttcagggttggaagattaaagttttggaattggaatcaggtggcatggggctccctgacgccacttcccaaccctgtggaaaacggaggtgaggagacctcggggagaaccaactcctgcctgtttaattaaagcacagaggattacgtgtcaggtaggggcgcccagggcaccaagtagtgaggagacttccagggggaagggtgtgtgactgtgtgtgccatgaggggcaggtccatagacctagcaggcaggtttggagggagggcagtgagcatccgactcagccagcactgagagcgctgctcagggcgcattgacagctgtggagtcagcccagccccagatgttagccgccactgggcctcctgttgctctgagacaagagactttttttttttttaattattattattaaacgtgtttatttttaattgaaagataattgcttgatagtattgtgctggtttctgccaatatcggcattaatcagccatacatattactatatcccctgtgactgtctttttttaagtaatttaattaattaatggctgtgggctgtgctgggtcttggttgctgcagacaggctttctctagctgtggtgagcaggggctactctctctgtggtgcacaggcttcagtatttgtggcatgtgggatcttcccagaccagggattgaacccatgtccatctgcattggcagacagattcttcaccactggaccacctgggaagcccaggggactatttttaattactttttctacggtacgagagcatttgcactaattctacttgtatacatataaactctttatacatgcccacatgcttaacttatacatgtttgcagtatcatcatgttaaggtgttcattttatatatttaaccccttaagcctggacttggggggcagcaatctctgagaaagttaacatctggtaatgtggccgaccttgcgttttctcaggtgatgtggatgactatagtgctgaggtagaggagatccttcctcagcatctccagccgtcttccagttctggccttggcacgtcccccggttcttcaccccggaccagtccctgccagtcacctaccatatcggaggggcctgtgccttccctcccagtgagaccaagtcgagctccgtccagaacgcccgggccccctgcttcacaaagtatgtgttttatttcaagttctgtatgacttcccgggctggtatgtttgatttagatggttaaacctccgatgccttcagatgtcctttggagaactatttttgcttaactttcacatccataggctaaagtgtagcatgttttctgtgcgtacaaaagaggaaactttgtagatggttccaccctaagtgaagaggagggtcgttgctatcactagatgagaactttacttcatcctttttccatgtggcaggtttgtccatggcttatcactgacgatttttaagcattatggtcagaacccgtaactctttgggcttaactatctgtacattacctgcattataataggaagcagaaagagacaaaacaagtattttgaattcaacttgatagtcatgactcctccaaagtcaggtttttctctggaagttgttacatcacacagttcagtcactgttccacactaaccagtacccttgaaaaataccttttatttcagcaatttctcaagctcccccatgctactcttagaggaccgtctttaaatagtcactgagttgtatctgactcttttgcgaccccatggattatagcctgccaggctcctctgtccattggatttcccaggcaagaatatgggagtgggttgccatttccttctccaggagatcttcccgattcagggatcaaacttgcatctcctgcattggcaggcggattctttagcactgagccacgagggaagccctcagaggatgggcttccttcagtaaattcaggataagtcaaggcataaagagaagaggctctctttgctttttcttctctctcctggccagcagattgaattgcaaatgacctaagtcacacagtacttcatgccatcttgttagggccgctcagtaaatcccctttcagtacccggggcctgggtaagaagtccagagagtaacctgattgctcccgtagtaccaaagggtaaggtaatagcacagctgcttgtgttactgatactaaaaatgtatgtcattcctctgtagtacaaattattttgctaaataatttatcatacgcctatagaaagtacctgtgtgctcgtcccttggaacctgatcctcttacctaaggtacttttttctggtaggttctcctgttgacactctgccggcaacacagctgcagcagaaagattcttcccagaccctggaacccaagcggcctccccctccccgcccggttgctcctcctgcacgtccagctcctccacaacgaccacctccgccttcaggtgacaaatccttgtatttccatctctgctggatttcaccactctgctgaaaaatgttttgcatgtttttgaaacactcgcttttagattttatcagttttctgtcactggtgctacttccttagttagcttttctctaacaaacggcataggcgtgacagaacagctagattcctataacatgttttcagagctggcctcttacaagcgtgcaggaaacatttgctttgtttttgctaatttgatgtggttgtactgatttctgtaaaatgcatgattatctaaaaatgaaaatttttaatgcatgattagaactgaagaacatacatctttctgtttacagttttatatatttgtttaaatgttcttttaaaataagtatagtcttgtttctgctagaggtatttgcgttacataataacttttttatagcaccaagatatgaatatgtagtctctacatgatatttgacatcttggaaactatagtaaatctttgacatttcaattctttatttaatgtcatttcctttctgctgcatattcccttatgaactataaggggctaggagtcctgcacctgctagaaaagagtttggaggtaaccatttatatttgttataatatatggatcttggttcattaatttttttggagtttgagctctgtaacttagtgacattttaggttgctttgatgcaagccaaaatgaatgacatttatatgccaacttaaaaataactccaaactttcattatatttctggtaaaagattagagcttgattttattagtgaatattattagaattaagaagaccttccatttccctgataaacagagttgaattacttaaggcctgatatactttttattaataaatatagtcaattcggttataaagattaaatgagtcaaacacaatgaaaataggtggtttcccaaggatttgattatattggattatattagaactctagtacgtcttgccagtagcctgtgaattagcaaaatgtcctaggaatgcagtttaaagttatcataattatctgaaatatagctttcattttgcatggctttatcataatttgtcataacattcatgcctcatttttaaaatagaagaacaagtctctgttatatatttcgataaagaaatttttcttaacacatgggtcactttttgtagtttacttgttttacatgaagactcttacaaagctcaactagaggcgtacatttgacaagtttatttaatctagttctcaagaaaggctgaggcagaatgtctcagtcccacagaagagctgttcctcacccagttctagtgtccttagggctcacgtgcacaggcagctggtctctccctgctccagctgcctgagcacgtcgccagccgactcacgctgtcacagagtggctgcaccgtgtgcagacttgaacgactttgggtaattagggtagcaaagttctttcagcaccaagcttctgtaagatactactggaggataacttttccactaacttaaagacgacattgatttttttcccatttcagacttgtgctttgatttatagcttcatggaagattttatttaccttcccctttaattaggaaaccaatctgtagaaaaatttaaagaaatttgtgaaaagctatacatattagctactcagtgacttacttagtctgatgttttttaaaaattgcttctcttcgtaattcttttgtaggcagtcttagcagcatattttttaaccctataaaccagtaactgcttgaaggcaataatctgaaagtaattatagtacttttagagttcttttttttttttttaataatgcattgaaaattaccttctaagggactaacacaggactcatagagatttaaaatgaaattggaacttccagacttttttttcctttatgactggcaaatattggagcttttattagtggtttaattctgaatataaaaaatgagatgattaaaaagcaaagactttcattattttcaaattccctactgctagtgaagaagtgaaagtgttaagtcactcagttgtatcccgactctttggaaccccatggtccgtagcccaccagtctcctctgtccatgggattctccaggcaagaatgctggagggggttgccatttcttcctccagggaatcctcccatgatgtcagatataaaaagaaaactattttctcctttcaattctaactgaagaaagggcaaggatcaggtttgggccaggcatctagaggcactttggtttatacagatatctttgaagaaatttgaagcagtgaaagaactttttttgcaaaaggacatttaactcagaaactgttttgtgtgcctgcctttccctctgttctatggaccctgaacaatacacagcttctgttctctctctaaaaaggtgttggagcccctcccagtccgggggtagctaggcgagagatggaaggtaacaagacgtttgcatcctagaaatggatctctcgttttattcctaaatgtcagcccctccagtgtttaaagacataccaaatcttttcttggtccaactgtaaactccccctccccctccttctgtatatcttgtaacttcatattttttctcttttcattctgtgttgtgtagtttctggtggttgtccatttactttctctgcaattcttaatgttgttttgagctgttctgtatatatatatttcatatacacttaagatgtgaaattaatgtgcagtattattttaagaggaatgccttcaaaaattttttcagaataagtcaaatgtttagaaatgtactgtactaactctgaagttttaaaaattaataattaaaccttgttaattcagtccaaggatatagtattttttaatcaacttcagataacataaatatgctgagtaaatttgcttaaaaggctattaaaactggaagccattcattaagattacagttattaaaagtctgatgggtttcatataacaattacacatgaatttcctttcaaaaagaagaaatctgagatgctgaccttaatagggtctcctactccttttggccccaaaagtagtttattgcatttcagtcttctcctacgtttcgaatgagtttgagcagtattttaacactgtcttgcataaggcagatattgtaataagtagtgcccgccttctaccttaatgatagggtctttctgtagaaatccgaaaggtctcgtaagagcccctgtccgtactgacgtccacagcatgaagccctgaacagtgctgtttggtgtcttgtgtgactcggaaagtgcgggtctgttggtcctggagccgtgagcccaccaagctctgggaagtagtggggccacgtcttgtgactgttcccccaaactgaccatgtgttttcagggttcataggaaagagctctgttgggaaagttaccttccaaatgaggtagcagaccaactgccaacttgtcccataaatgttactctcaatagtctaaatttttctcttttggaggtattttctaaagggctgataataccctccagcatttctaaagcagaatagtttgttttgtttttctttttccacctcgtgcccccatttctgctggtaatgaaacagaacagctagctaatattatataatatggcttatttacttatagataatttttttttccttcctgcttcaaagcacccaaaagcccaggaacgacccggagagataatctaggtaaacattcgaattcagctacttaaccttaaagctggaccatgaatagacagtgtggtataagtgcatgtttcttgtttctttctttaaaaacaaagacctgagctacatggtgtgatgtctttgttccaggacgcagccagcttccacctcaagccggactgccaggcccgggacttgctggacacagtgcagccagaccggtaggcagcgcctcgcttgcgagccaggaggtctaggtcctgggtcccaacttgctactaatcaaatgtgttaccctgaagaaatcacgggcccattaagactccaatttcctcaattctaaattgggggaattagacttgatgctcttcaaggtaccttcgtgtgtatgtgtgtgtgtgtgtgtgtgtgttttactctctgaggtgtgtgtgtgtgtgtgtgtgtacttgctgagttgtgtccgactctttgcaaccccatggactgtaccccatcaggctcctatgtctatgaaatttccctggtaagattactggagtgggttgccatttccttctccaggggatctccccaacctagggatcaaacccgcttctcctgcattgagaggcagattctttaccactgagccaccaggcagccccaccttcaactcaaatggtattctaacatcctcttcagaagtaaaagcatccttcattatttgaataaaagtggtatacttaagtgattacagtcactaaataaatatcttagaatcttgaaatatatggggaagtgatgtactagggcaattttttatgacattatctgagtaatgaagtaaagtcattcttctatcagaaaggttttattttacttttatttcctttttatttgtctttgccacaccttgaggcatgcgggatcttagttccccaaacagggattgaacccgcactccctgcagtggaagcacaagtcttaactgctggaccaccagggaagtccagaaggattttaaaattagatttcaggaaccccaatgatgatagtctgtcaactaaaactagttctaaaggtttaaccacaggagagcagatggcattgcagggtttcaccctgcgttgtaagtctggttttctgcgtgtttatgtgtgttttgttatacacagaattattctattattcacccacatgaacattttctctgagacagaacaagtaattcaaagaaaaaaaaaaagagaaaccagtgtcagtcaggtggagcctggacttattgggaggccactggctgaatcctgggaactgtgactatacctggagatgaagagacttctgctaatgaaactacttcaagagtccaagaaattctcatgagatttctaaaacagagatattttgttttttgtcttgtagccaacctgaaggactttttctatatataatattatgctccaaagtaaagtgtctgtggaatttacctaaaatagccattatccactcccctgtttttttaaaaaagaagttgttattcactgactacacacttcccacaaagtactttgcttactgaatattgtaagaatagggaaggaaagtcaggattttgtgtgattacatttataacttttgcttatgcatggaatctagaaagatggtactgctgaacctgtttgcagggcagcagtggagatgcagacacagacagcagacttgtggacgcagcgggggcaggagagggtgggactaactgagagaatactatgctgctgctgctgctaagtcgcttcagtcgtgtccgactctgtgcaaccccacagacggcagcctcccaggctcccccgtccctgggattctccaggcaagaacactggagtgggttgccatttccttctccagtgcatgaaagtgaaaagtgaaagtgaagtcgctcagtcttttcagactcttagcgaccccatggactgcagcctaccaggctcctccatccatgggattttgcaggcaagagtactggagtggggtgccatcgccttctccgagagaatactatggaaatgtatattaccatatgtaaaacagatagcaagtgggaatcggggagctcaactctgtgctgtgtgacaatttagaagcctgggagggggtacaagagggaggggacatgtgtgtacctgtaggagattcaggagggaggggacctccatgtggctgattcatattgatgtatggcagaagccaacaaatattgtaaagcaattatcctccaatttatacaaaaataagaaaaatgtactgagtgcttaaagccttcagcaaacatgtgaagatagaaaaggacgttatttccctagtgtatcttccagcctatgtatttcagcacattgagttagccattccagagtttttaacctctgtgtttaataaagaaaaacagcctcagtgtagtttttggtaagcctcttagttccacagtgtatgtcccgctccacctcctcatgacctgtaaaatcgtcccactaaggagtatgatacaggataaagaaaacgggccctgagttcggctcctggctttattttgtaactctgtggctttgggacagttgtatacatttcttcattttcatttaaattagagatgataaaataataccttaccccccagggccatttggacattgaaatgtaaattcatacccagtgcttagttaacacagtgcgtggcacatagtaaacagtgaaaaatataaaggaagatttttgaagcttaaggaacaaaattgggtcatttgtagagatgtggatggacctagagagtatcatacagaatgaagtaagtcagaaagagagaaacagtattgtgtattaacccatatatgtggaatgtagataaatactatagatgatcttatttgcaaaccagtaatagagacacagacatagagaacaaatgtgtggataccaaggggcaggggaggaattgggagattcgagttgacacatatatgtgtgtctgtgtgtgtatacacacacacatatatatattactgatactatgtataaaatagataattaatgagaaactactgtatatagcacagagagttctacttaacgcactgtgatgacctgaatgggagggaaatccaaaagggaggagatatatatatatatatatatatatatatatatatgtatgcctgattcattttgctgaagagtagagaccaacacaactttgtaaagtaactatgcaccaataaaagttaatccttaataaaaaaaaatgaaacttatgatcatatggcaataaatagagccattagaatgacaaagaggcagaggaaatgatacaagatgcacagacaaaatattttcatcaaatcttatccgttgcagataaggtaaatgtctcagtggttttcgtttcccatctttagattattccgccccgtgctggagtcatcagcgccccccagagccacgcacgggtgtctgctgggagactgactcctgaaagccaaagcaaaacctcagaagtactgaaaggtagacccgtagtcaaaacagcagtgccattctgtatccttcccttccacttcttttcttttttctttcgcaatctctcactttatacaacttgctcaaattctttctctctctctttttttttttcctgtctttctgaatgccataataaaggaggctactgggggctgagacagggactggaatttcctaccatttcctgaaaggaaggataaactcagttttccagagaatgcctaacatctggaaattactttctttagggccagctcttcttcccgagcccctgaagcctcaggccgcccttcctgtgccgccttctcttgcgccaccttctcttgcgccacctgttcagaagatgcaggagcctctcatcccggtggccgcacctctggcccaggctgccctgcagcccagcctggaaacgcccccgcagccaccccctcggagcaggtcgtcccacagcttgccttctgagcctccggcgcagccgcaggtaaggccttccagcggggagaaagatcatctgggtgtgtgtgtgtgtgtgtgtgtgtgtgtgcctttgcttacattttgttttgtttttccctttttttttttttttactgaggcatatttgatgctcttgctgtagtctttgaacatacttattttaattattagctttagaaaaaacacctaagatttgattttttaaaaaattttgtcatttgctagtaataacatgtttagatatgacttcaaccagtgaatgtcatttgaccactcagactcatcacacaacaaaagcacgtttggccgtttgagggtttgggttttttgtttgtttgtccaacctgttgtctagatcacgggttctcagagagtgaccctagattagggctctttccctaaaggctcttttccctaaaacttccaagcggcccccacgctgtttactttgtttaaagagtaggtgatttttttggtttttctgtgtgtaatttactttggatacttaattagagtggacagtaataacttagtttctttttgttcacagctattagattagttttgtcctttacctcctggacagaaaggcagtcaggtcaatccctggccattggcagtaaatttccaataatcctatctctcctgatgctgcagttagctcttttcagtgatggagtcggcactgggcttccttggggatctctaacagtttcagacactactggatccatttagatgtttcaggcatgcagcagcaggcttattaaccaaagtaaaagccatcaaaataatgttctcatgagtatcacatagaaaatagtaccattgccttggtgggtggaaatcacaggatcacagggacttttgttataccagagtgatctcacattggaaagccttctggtgtatatacacaaagttgtttcaacacaagaatattcatgcgagttgaattgttttacttggaggctgttttacttagtttttattatatacatctcagtaaaatcattaaaataaggtttatctttagtataagtttatctttagtataaggtttatctttatatttctgttgtctagcctcacattgaattttatccaaaagttttaacttgaaaatgccatcaaggccaaagaactgaagtctaagtctgcttttattttggaatagtctaaaatacagaaatattacactggtgatgtcccttaagcatgtttataataatagtttgcatttatttttacagatatgtgaatatgtccaactaattggcagaagttagcagtttcttatgcttcttcatagtgaaaaaaagattataaagtaaatatgaatcttgaaacaatatgaatagttagcaaagcacttacttatcagactattggtcacattttttaaaaagctaagacggatatataattgagaataatgttctcttaagctaatgaacaccaaaaagtattatatagttgaggatgctgaagatatatagtaattatagaagcccttcaaacaataagtgtccattattttctctttgccaatctacttttagtgcatgatgattttttcttttcattttcttataaggtgtagtatttattattattgttttttagtgtaattggagggcaagaaactttcaaagaagccatcttaaagctttgtattactacagttttaggacagaaagtgatcatgattttcacagtaaaggtgaaccctaattcctaaaactctataaaatgttctcagtattgaaagtaggtgtggtactctgaacaacttcagaagaacacactgtcaaagaagattgcagttctcagtagaaagtcatcttgtgacacagagagtacaggatgaatattccgtgactgccatctatcattttcttaggtcattttcccctgttttgctttctgattttcattggaatgggtatggtgatttgctgacgaagcacagcaagcctgtgctttctgtgtggtttagtagattgtattcttgactcttacattctgctcatcaaaactgtgaaaggtgtttgttataagcctttctttgcctcagtcattgatatcaaatccctctacacattacatacacagacacactttcctggagagtggaggtcttgttcacgtgtaggctgcctttgtgcaagatcacaaagagcttagtttcctcctgggagcttacagaaagatagggaggcattttaccttttttgcctttttcattttgaaccataaaaataatgcctattcaaaaaataatgaacatctaaagtcttaaaaattcttctataatggctataacttgaagagggtgagttagtaaaataactcacattttgatattttggtaataatatgaaacagtcttagaattgaacttagtagtttttacaagtctttattaattctgccaaaaatatacaaggtatttaaaacatagacccacacatgacccagctttacttgttattactatttaaattatttgattctataattctatatagaaaagattcttctaattcaagtgattatatgttatatatcctttagaaaatgtaaaaatgccccacttatctgactttcaatgtcttaggcatctgattatcagctgaaaaccagaagtcaggaatccaatgggaagtaaagtaatagcatcacagctatactattggagtgacagccgatagtgagggaagaggccaagtagaaaatctcaggacttccctggcagtccagtggttaagaccccgtgctcccaatgcagagggcatgccttcgatccctggtcagggaactaagatccagcatgctgcgcagcacagccaaaaaagaaaaaaaaaaatctcagctttctggatcaatttaataccatccccttgcatcttagtataaacccattcccagtttttatccaactcttacaaaactaatgcatcaggatcatcaggaaaggttaaattcaggagtctcatgttttgtagtaacacattttatataatataaatatataataaatatattatttataaaataatttactatagaatggtgtctctcgaatctgtctaagtgagttatggtattttaaaataaggtaagctttaaatattggggaagatttgttcaaactgtttcttaagaatactgtaattttttaaagtactgctgttatagaaagattgtgatttcatctttagtatcacccttcagaaaatttgagtgatagattaatagaacaagcctggatcctgaccatgttaaaataaataccagttttcacttttctgcaaagtggtgccattttgaacaatttctctaatcatgataaacccataggctgtcttaaggctgtgtcctaaccttcttgggctgccgtaacaaaataccatgaactgggtgactcaggcagtagaaatttgtcttctcaagttctggaggctagaagcccgagatcaggatgccagcatggttgggttctgctggggcctcttctcctgtgcccacatggcctttccttggtgcttgcacaagggaagaaagagcaagccctctggtgtgtctcctacaaagggtgctagttccatcaagagggcccactctcacgacctcatctaaccccagtcacctcccagaggccacgtctccaaataccatcacataagaaggttggggttcagcatacgaatctgaggggacacaaacatttcacccatagcctgctgaaaatacttcagtgctccagtaatgtatttggaatattatttttggaatgactactttgaactagttagtaatcaacctcagataaaattaaatcctgagccctattacagcaatacattttattgtctcttgatcttatactgtgacctgcaggtctcactgctgttggattttgtacataatataaaactgaaagtgttttgaattgttagggttgctgcttggtctcagattgtcctcctaactctttcccttgatgtctatgtttcgttttctcaaagcaggagcaaccatcagggtaacaggtatcggattatttctcaatcttatatgtgcttctcatctgtcttagcacagtagatgtatgaatctttcgcttcatacatctaaattctcacccatttttaaaaaccacctgtccacattaataaattctgttatcataccataaaacctgctttttttcttagtattttgaattcttaggaaccattttagttattcttgctaatgctttcccattttgctttttttttttacaaaaattaacaagactaaaaagtataactttaagaaggtaagctttagatatatgaaagtgtatttggcaaaaccaaattggttcgtggttttaacaatggcaaaattatgtaagtataaaattcaatttttttcctagatttcttttgggaaattaaaaaaacccaaaaaactagtagcatgtagattataactggaggcactaggagatttttttttttgttaaagaagaattgatgatttacaaaaatgaaaatgaacattatagcaggattatttaagggcctttccaacacccttttctgtaaaaaataccatcatcattaatgtcaagtcatcataaatactgcttagatatatagaaattcattctaatgtaatgaatgatgatgtggctctcataatttcaaatctcattgagcaaaatgatcatgtttctgttaaattacctttaacttattttgaaagaaaaatttgttaatatatgaaaataaagatatttaaatgtgcaacatttatttggcaaaagcctattattctaagctgtacaaagcataaacttcctacctataatgtctgtgtcatggactctttgtctaccatgggagaatcggggcccagacccactcaagtacttctgttttgtcatatgaatcgtaaataacccagtcattactggtaatgtgtagctaattgtaattttacagcatctatagtaaatttgtctctcaagtactataatacacttagaatacagtttagaatttatgacatgtctgctttttaattttgttcaaatttattgtcatattaagtttgaagaaaaataaaacttgtttacttaaagtatactatagattagttgaataaaatagatcctagagagtgattcacgtaagaagttatccacactgtttccttttgcaaatgagcagccttccttattctttttttttttttgccactgcatgtggcttgtggggtctctgttccctgaccaggggttgaacccaggccctggcagtgaaagcagagagccctaatcactggatcggaggggaattagccttccctattcttaagcaccaagttactgtttaagaagatgcaattatgttttattggagtttcccaggcagctcagtgataaagaatctgtctgctaaagaagaagacacaggttcaatcctgggtcaggaatattccctggagaagggaatggcaacccactccagttttcttacctggtaaatcccatggacagaggagcctggtgggctatagtttgtagtcgtcttgtggggtcacagagtcagatatgacttagagactaaaataagaacagcaaaacaatgttttattgagactgctgctctttttctcaacatatcttatgaatgtttagttacttgctttaacaatgacctaaattcatttgggtcatgctgcattttgtacattgccaagtctctagctaagtaaaattctccctctcctgtgcttttcttacctttaatttggcataaatatccaagtcacccacctagttttaacaattatatagagttttttttttttttaattaaaatggagttcctgataaagctagctacttttctcgtacagccaggcttcagttcaatgtttcccttaggaaagtagcctgtgcccggtaccacagccgggctccactccagccggcttctttgtgaactgggcacacagggcagacttttcataactgtgaagtaggtctgacccctcctcctgccagtaactgttcacagctagctctgccatgcatagctttattttggttgaagaattactatcccaaatagaaacaggattcctccccccaccacgccatccagtttaaagaatcattgcagttagttacaacctatctaaagatgaggaaggtcaattaaaaaatattttcacattcagaatttattctacaaaggagagctgacgttaaaaggcaaagaatgctttgaaaattttattctacaagtggaaaaggaaatgatgcattgtcttcagcttatgaatatagatatactaataaaattattatccataaagttgaatttccatagtaacattaactctcaatgaaaatatatttcaaaaaacaatgaaaccacatcatcatcacagatgggtgttggaagtttattcatagcgatttagcataaactttgtattgaatgtgagttttttaagttcatttgattatctgatagaactgggcatgaaccaaactcatctgctaattcagtgcagttctccattttacgtatcaatacttgcatggatgaaataagttgtatttataaaagaacttatttagcagagagttttaaaaaaaaaaaaaatttcatggtacttgtttaaccaccagagtaacagactacacaaagctcctttttttattttttgagtatgtatacttgaccccttcagaataaagaataattgagacaggaaacagggggggcattcaaagtaaccttattgctttttgtttgttctgattattcagtgggctctctctttcccaggtgaaaacaaacggagtctccgccgtcagactggactcgccattaaagagtgacccatttgaagacttgtcattgaacctgcttgctgtatcaaaggctcagccatctgttcacaccccaaacccaagggggttgacgccgttgccttctgcagccccaagtaacaccaacactctgagttctgtaagctgcatgccgacaatgcctccaattccagcccggagtaaatcccaggaaaacacgcgatgttccccaaacccattcatcccaagctcaagcagcacaaatcctttcaccgacaggaccgccgctcctggaaacccctttcgagctgagtctcaagaatcagaggccacttcatggttctccaaagaagagcctgttgctccgagtccattctcttcgctgaggcctctggatcagaacagtagcaagccttcatcctccctggatgggtttaaggacagttttgatccacagggcctgtctgcactaacagtcagcaaccccaaaggatgggtaaccttcgaggaagaagaggactttggtgtgacagggaagtcagggtccactcgcccagacgttttcctgggtaagcagctgagctcgtctcctggctccaaggtgatgcttggtgatgactggggtaggagtaccaatgtgtctctctgtgtgttgccagcaagaccaccacccccaccgcctgtccctctgctcccacctggcaccacccctcccgcagacgctttcacagccctggcctctaaggcatcacccacgctagacttgacagaaagataacgtcacacagtagagagtccctttagttttggcagggtacagccaaaagatttgggcattcgttattcatgatgtgcaataagtaattgttaagtgcactgatgttgtcatgaaataccactatttaatgtgtacagagttggaatatgtgtatatcagaattaaggaaaaatttttctcattattaactggaattttggtgtgtttctgtttggataaataagagagagtagaagccataaaaagtgctcaaagctattttagaaaacagtcctcatttagaaattcttcatcagtctcctttagagcatctcacaaagcccagacaacttctagaagacattgctgccagccctttcctacttgtcacaattggtatctataagtatttaccaaagagccgtcaaaggtatactggaacagaatttagaaagacattgcttaaaaaaaaagtgtatacacacacaaacacacaaatgtatacacttacatactggtaaaatacatcacttaaattctagggtataagtcagaccaaatttttacctaaaagttgtaacagagttctcttttccatataatcaaatggatggttgaaaatgaaatttggacatttccattatctttctttccaaatctagagtaatctcacgacggaaccagaatttgcccccgttgcacacccaccccttctgacacacacaccacacacccccttgtcactctggtcccacacctctgcctgcttttctgggggaggagcttcttgcagccggaagtagcatattgtgtggaccgaccctcctgtcctttcaaaacagcacactggctacagatagcagggaggcacgtgccaccaaattcagtgagaagtaaatgggagttcaaggtccacggaggtgtccgaggatggccctcctcacttctctagctggtgagccgggcagccccgactccgggggcgctgaactggaatctgctgcgtgttctctcgccccatctgtgatgctgctttatgttcttagaggctacacctcaaattagctgtggattttgtctcctgcactgccagtatgcagctgatcctgcttttgattaattttatgaagacgttcatgacttatagagaatgtagtattttgatatcattgaggaaatcccagtcagaaaattcctggagcaatagttgttttgttgttagtttgaaatcacttttacccattatattagcgttttatacaaagagttgtaaatgtcacctgaattacgttgtccacatttaacctttaaacatgtgcattgggggaatatcagaaaatggagttcacgactaagaatacataagatgtaaaaaagcacagcaagctgcatcgcacttaaccacataaagcaaaactattaggaaaaagcacttttctaaatgctcaaatgttatcagaatactatatttataaaagtaattctctctctattaacagccaggaattgctgttagaaataactctcgtgagttttatattgtgcttttggggggggggggtctaatcatttcagcagtagtatattttaaacagcagtattactataagcaatgtgcttcaaaatgtgaattaacttgttgaaactgtggctttaacatctgtgtgattagtgtatatggtatttgctctccgttaggaaaataactcattataaactttagtgcgactgcagttctgtgagcagtgtttcctattgaatagaaactactgtctaaaatacacatatcaagcagcagctcagcctttatcaggaaattctgctgatacttggcaagttgctgaaaaagtgcacaaagttatgacagacagttaaaggtacactgcaaataactagccattattctacatattattacaatatggaccagttctgttaaaagcagagcagaaactagacactaaggatctctctgtgagttctttgttctctatagtagattgctgtttataggtaagaactttattgcttatgtggcacacagtatttataactatgtactttataggagtacagtattaaagtcagtggcatataaacactgaacatatcctgtgaaatttgctgtcgtatgaaataaatatacctgtctttaccatactgactgctttgctcaaaagggaagaacttttctcagctattttcctttaactttacatagatgagtttggcgatatttgaggattaattcttactgtcaaatcagttttgtttttttttccaaatcaggtattttaattcaagatgttattctcatccattgtatttctctgtgtgattgttgttcagtcgctcagtcatgtccaactcttggcgactctatgcactgcagcacgccaggctttcctgtccttcaccatctcctagagcttgctcaaacttgggtccattgagtcagtgatgccatccaaccatctcagcctctgtctctatgtgatacttctgctgaaagtaggaagctattctcaaattactaattgtcattaagaagtcatatgcttattctgtaagaaaggccctcattcaacatcttgctggcttgaaaataacacaggaggcatgaatgatgattttctgacccacagcaaaagaaacagctggggggtgggggtggggcgggtgaggggagcagaggggaaacaggctaacgaatagccagacaaaagaagagattgccttaaaagacctaaagtaagagactgaggctggtgttcctgtgagtattgcctttttttcagattgctatttcaaacaataaccttgattcttaaatcaattatgttcattaatctctgtttaagaagttacagatacagaataataggctttgtaaaaactttttattttaaggtaactgtagatttgtatgggcttccatggtagctcagacagtaaagaacctgcctgtcaatgcaggagacaacaggtttgatccctgggtcgggaagatcccctggagaaggaaatggctacccactccagtattcttgcctggagaatcccctggacagaggagcctggcaggctacagtgcatgggcacagcatagcaactaaacaacaacgtgcagttgtaagaaataatacagaaagatcccaggtatcctttacccagtggtaacatttgcaaaactatagtgcagtaccacagccaggactttaacattgatataaaagatgattccatctccctgaagatcctgcgtgttgccttctccccacttctctcccatcccatgcccttctcctgtgtccttaacttctggcaaccactaatctattctccataatagattctgttctccatattcactatgattttgctacttgaagaatgttacataaatggaatcatgtgtgtataacctttttttttttgacttttttactcagcacagttctctggagattcaatagtttgttcctttttattgttatatagtatcccatggtatggatgtatcacaattggtttaaccatttattcatccactgaaggacatttggggtgttcccagtttgggactattataaatgaagctgctctgaacactcatctcaggtttttatgtgaacgtaagttttcatttctctggaataaatgaccaggggtacatgctgggtcatagagtggtagcatgcttggatttttaaaaagcttccaaattttctgctagaatgacggaaccattttacattcccatcaacaatctatgagtgacccactttttcttatctttgcctgaattgcatcgtggctttgtctttaccctaagagctaatgatggtgaacatgttttcatgtgcttatttgccatctgatgcctttttgtgtgtgaaatatgtgtcttttgctcattttctaaatagattgttttttaactgtcatgttttgagggctctttgtatattctagagactccacctctattgaatatgtgctttgtaaatatatttctctgtctatagcttatctttcagcctctccacatgatttatagccagatcctaagccctgcaggtccacaattaccagcatgagtgattgacacaggaaaaccaaactcatgtacaaagcaaaatgccactttattaatgttaggaaaaaagtttgaccacatcaagatatcaaacgtggaaaaatgggaactcatacattgttggtgagagggcaaattggcacagcaattctagagaacaattacataacatccagtaggacttccctggtggtccagtggttaagaatccacctgccaatgcagggggacatggattcaatccctggtctaggaagattccacatgttgctgagcaactaagcccatgcaccccaactgctgagcctgagtgttagagcccatgctatgcaacaaaagaagccacaccatgagaagacagtgcaccacagctagaggacgctttcagggagcaacaaagacccagcacagtcaaaacatgactaacttaaaaaatacataaataatgtccagtaagattcatatattctatcacaacaaatttgacttggagagaaattctaggacaagtggagtaggaatgcacattgtttgtaatggtgaaaactggaaagaaactaaccctcaagaaggggatggagtgacatatttctggtggaatactatgtagtagtgaaaataagtgagtgaaatactagtaaatttcagtatggaaccataaagcaaggtacaaaataatacagtatgacattcagttccgttcagtcgctcaatcgtgtccgactctttgcgaccccatgaatcgcagcacgccaggcctctctgtccatcaccaactcccggagttcactcagactcacgtccatcgagtcagtgatgccatccagccatctcatcctctgtcgtccccttctcctcctgcccccagtccctcccagcatcagagtcctttccagtgagtcaactcttcgcataaggtggccaaagtactggagtttcagcttcagcatcattccttccaaagaaatcccagggctgatctccttcagaatggactggttgggtctccttgcagtccaagggactctcaagagtcttctccaacaccacagttcaaaagcatcaattcttcagtgctcagctttcttcacagtccaactcacacccatacatgaccactggaaaaaccatagccttgactagacggacctttgttggcaaagtaatgtctctgcttttcaatatgctatctaggttggccataactttgcttctaaggagcaagcgtcttaatttcatggctgcagtcaccatctgcagtgattttggagcccaaaaaaatgaagtctgacactgtttccactgtttccccatctatttcccatgacgtgatgggaccagatgccatgatctttgttttcaactaatgtcatcttcgtatgacatcagttatatcaaatttaaaacataccaaacaatgttctctatttagggatacatatgtgcgttatgtatgtatgctcagtccctcagttgtttacaactctgtgaccctatggactgtagcccaccaagccatgggattttccaggcaagagtactagagtgggttgccatttctttttccaggagaagcttcctgacccaggatcgaatccacatctcctggatctcctgcattgcagccggattctttacctgctgagccatgggggaagtcccacatacgtgtgttaatggtattaaaacaattttttttcagtacagtaaaaattttcttttcgtctctggttgcctgatatctagcagtcaacatgagtgccccattaattatctgtattggagtgtttatcactactaatggattgcttcagcagatacaaatgcttataagatgccctttaccgtagaaaggaaacagtacctaaaatatttagataagccaaagtacataggaacacacagatgtcatatttgtcttcaaattcagaacccacttgggtgacaatacaataggctttggcatgatgtatgatcacttaaactacaatgaggaaaagctacacacaaaatttgtatgacacggcctgggtgagaagaaaaggaccttaagaaagcacagaaaggactgcaatgtaagaatacaaaggcaaatagcagtgctgtcaaagattaaagatggtgcacctgttcgacctgtgacagcgtagttaatgggcttccatggtggcccagtggtaaagaatctgcctgccaagtcagagaccctgttcaatccccggggcacgaagatcccttggagaaggaaatggcaacccattccagtgttgttgcctggagaatcccttggccagaggctggtggggtacagtccatggggttatggacacaacttagcacctaaacaatagcaacaatgtaaagtcggtaagtacagaactggatgaccagtacaaacacgggttttctattcttttcattccttttacatttattaaaaattataccccgagaccctgtctgtaatacatgagtgtgtggataaatggttctcactacctagaaggctgtatatagcaagttttaagcaggagtggcctgatggatacttagttggattcaggagaaaatcggaggaggatcctacagccagcagtcaggaggtaggtgaacccagtagacccctttctccctctgggtaaaagacatttgccagtctgaccagtactgcatgttccagggtctgggtgatccctgccctgacagtactagagacgaaaacacacctctctccccgctgggcgccatcccccttctatccagtatcattctagcagtcttcacatgaggctctgggttgcctcgacgcattcccaggcctacagtctcccactttcttccctctgcccggggaacttgagggatacagatttcaacgcagggagtcaaaagtttcaggtacacggagtgccaggtgcttgtaaaattcaaatcaattcgtatttggcaacggcccttccaagcagacaaccaggggtgaggatcttgcactacttcgatagctttgcaagcgccttgtgcgtgagcaaggactcagtgcaaatgttacccatccctttaagacattccttgaccatcctatctaaaaagtccatcaccctgtttgtttttttactttttaaaatctgccttatccgtttatgtttgctttcttgttgtcacttacattgattataagctccgtgagagcagtgaccctggacctgccgccctgtttgggaataaacagcgccgcccacgactgcctttaataagaattttgctggacagtgaatgacgacagtttggggagcgtcgttccggcgtcagccgcgccagatacactagacttgggcatccgaatcaccccgcatggagaagtacgggcacgttccccgattcctcagtcctgaagaccaaagaaccaacagccgacggtctctcctcagccgtgcgtcacggcctctctcctcagcgctccagaccggaagcagccggaggcgtttccggaagtggagactgcggaaggcggaaaggctggcgaggcctcgagcgacggtgggaacactgctgtgggggcttggcgtctctgggtgcccgccaccccttcccattcccggtcgagcaacctccctgcgcctcccctcccaactccctggatggaatctcgggcccccggcgagccgacccagcggccagaactcccctcagccagctggtcggtttgagggttgccacggcaacagccacttccgggagcggggtctcggcgaagtcagctcaggcggtgcgggggccggtccgggagcctttgctcggctgcacctactgtcccggtagtggagggaggcccgggtccccgcgcaccgtagcttccccagcctcagggtctgcccttgagccgtgggccccaacccccgccctcagatcgcgtttctctgttgctcctggcagcaggcacttctgagagcgggtactgtttccccctagtcccctccctctccccgctcccagatcgtgtttctctgttgctcctggcaacagccacttccgggagccgagccgtttcccccagttcccctgcccagtcccagcaccgcgaacgctcgaacccggggttccggcctcccggcaaccgttggtcggtgatcttcgctgtccgcccgcgggggtgggtgacctcaggccgcttgtcccgggccttccggcggggctcccgcaaccaccatggttctgctgcacgtgaagcggggcgacgagagccagttcctgctgcaggcgccggggagctcggagctggaggaactcacggcgcaggtggcccgggtctacaacgcgcggctcaaggcgcagcgcatctggtcaggtgcggcccggcggcttggggcctgggacgggaggagagaaccgggcccgcggggacggggtgaagttgggcgggacccgccaggcctactcgggccgactaggggcgaccgagggtcaggccagtgaagactttgcgaagacgcgcagctgccgggcttgagatggggaccacgggtttccccagagatgcttccaggagcgactgcaccgcgtgggaaatcagtccagaatattcagtggaaggactgatgctgaagctgaaactccattactacctgatacaaagaactgactcactggaaaagaccctgatgaaagattgaaggcgggaggagaaggggatgacagaggatgagatggttggatggcatcaccgactcagtggagatgagtttgcgtaaactccgggagttggtgatggacagggaagcctagcgtgctgcagtccatggggtcgcaaagagttagacacaactgagcgactgaactgactgcaccgcgtggaagggtgctcggagcagacgggacgggccgttccacggcctggggagtcgggattgggcctctaagcaaaacaaaccgacctaagtcccgaaaccgaggaggggggaggggggagacgggaggtggcacaggagagagccgagagcctggaccccagagcaggtgtaggggatctccgcaagtgtgagaggtgggacgatccccgggccgatttttaagagtgttctcttttgagactttgaagatagagcagtctccgggggggtttggggcgggtgggagagccacccagctttgggatggttttcaagggcgagagagactcggcgttcttgcctccctccgtgttccctgctctcggaaacagcctgatcctcatgttacagtgttttggtcactgccccccgcccatcccccaccccccccacccccaaccccggagccgtgacggccaatgcaactttccaccgcgcggagatgttccctggcggtgccgtctagcagtggtagttgctgtaagtcgtgtccgactgtttgcgactccgtggtctgtccacgggattctccaggcaagaatacactggagtgggtggccggtatcacaggtggctgttgaacaccgccaagacactgcattctttatttcaattcatttaaatgtaaattctagcggtaatgtgcctgccaatgcagaagacttaaaagccacagggttcagtccctgagttggaaagagccctggaggaggacatggcaacctactccagtaatcttccctggagaatcccatggacagaggatgcctgatgggctacagtccatggggtcgcaaagagtcggacaggactgaaaggagttagcactcagagcctcctgaagctcctaactgttgccttaggcagcacagtacttgacagtgtgttagtccagatgtgatccacgatgtgattgtttgatttttgtaccatagagtactccttaaggatcataaactatccattccttaagaactcatttgtgggtcatatgtatcgtttcttagtaaaatttacctactccagaccaagctcaattaagtgttattttaaaatcaaagcatctggaggggaaagggcctcagcttctttttctgtgaaattatcaattgaaatgtggtgctgattgttcagagtctcattagtgaatgggaaacccattcatttaatctgtgctacctgttcagtcgtgtctgactctttgcatccccatggactgtagcctgccaggctcctctgcctatggaattttccaggcaagaatactggagtcgggtgccatttcttccagggaaatcttcccaactcagggatccaacacacatctggcaggcggattcttttcctagtaggtcagatggtaaaccatccgcctgcaatgcaggaaacctgggttcagtccttgggttgggtatgtattcaacttctcagtgaatttcaatttatgcctcctgaatgccaggaggtataacatagcacagaggattggcgcacagaaactgcagcctgtttccggtgggtgagcccccagactctgcttctgttgatctaggatgcatcggtgcgcatttgtcagaggtcagggacaggtatgccatagcaagtgacatctaagtgtctgctaaataaaatagccaacgggcccctgacctctaggaagtttccattccagtgaagtgtaaggtgttataataatgactgtgatgcatattgtctaatttcctcttgtttttaagaaatggaagaattagcagaacatggtgtatttctgcctcctaatatgcaaggactgactgatgaacagattgaagaattgaaattaaaggatgaatggggtgaaaagtgtatccctagtggaggctcagtatttaaaaaagatgacattggacggaggaatggacaaggtaatccagcatttttcttctctgcacatgcctgaatataacaatcagtgtgaaaaagtcttcaagttaaaaaactgacctcagtatttctattcaaaatgacaaaaactgtaccatataattccttgttgttatttagttgctaagttgtgttgaactcttttgggaccccatggactgtagcctgccaggttcctctgtccatgggattctccaggcaagaatactggagtgggttgccattttcttctccaggggatcttcctgacccagggattgaaccctgggtttcctgtattgcaggcagattcgttagtgtctgagtcaccaggaaagcccatattaactccttatagcaaaacgctcggagaaagcgatggcaccccactcaagtactcttgcctggaaaaccccatggatggaggagcctggtaggctgcagtccatggggtcgcaaagagtcagcgacttcactttcacttttcactttcatgcattggagaaggaaatggcaacccactccagtgttcttgcctggagaatcccagggacgggggagcctggtgggctgccgtctatggggtcgcacagagtcagacacgactgaagcaacttagcagaagcagcaaaacactaatccaggatgaattagatggaaaagaaggcatctgtcttcttgctcttactaagtttcagctagcttttaaatgtagtagatgaaccacaagaaattaccaactttataggcaacaaataattgaaaattggcattttcatatcgttcaatctaatagtctgaggggataatcattgaaaatatatcacagggcatgttttgttacagtttgtacatcagaatttatttagcgattgtgtgtggaaagaggaaataaatgtcagcccagtggtctccacttgaattgaggacaggccgctctcgtacaaagcagtttaggacaggcagaactgaagaaattagtctccttttagtatatggttgttcgtgtgggattggaggggaaaagggatggtaacctattttgataccatatcctttttaacctgcataaaaagctccctttaaaagattataattgatcagttaacaaacacttaagtacctattatacccttaaaacactcttaaaagcaaaagaaagaaagtgtccatgcaaaagaaagcctttgcatactcagaaaaaaaaattaatactgaggataataggaatttctattaatggtatttattttgaactttaacctagaaaataataatggttgtcttccacatcttttcatacctaaatccattctcaatttggagagatttttttttttttttgctttttagctgaaattgcatcaaagaaataaatcatggtacttgtaaaaacagttaacagaacattaccagttcattattcatctttaaatcaagattgtgttaatcactttgttttagtacagttttgtatttctagtattttcaatgactaagtaccagtgttatttattaagggtatcaagtttgagagatctaactaataactaacttctgacgtccagctttcctatgtcctttgcctggatccattcttgtactttctctcatctcacttcctcccgactcagacagaaggggttacgaagaatcctaaagatggctgtttctctcccccttccctttttttatttttagctccaaatgaaaaaatgaagcaagttataaagaagactatagaagaagccaaagcaataatatctaaggttagctttttaaatgatattctaaaacttgtcttttgaaatacaaattccagttaatggcttccagagttatctgccagccagctttttttcattctttctttttctctctgtttctctttctgtctgtctctctcctcctctcccaccgcaccggccccccgccccctgacccttccttccagaggcaaaggaaacaaacatgtttagagtgggccttagcttgtttttttctttccctttctttcccgcaatcctctcagtttcttcaggtcagacaaaaatggttattggcttgtgtaaatgtagttcaaacatgaattggtgctcatatgcttttttttccttcttgttgagctgtagttgatttaccatgttgtgttactctcaggtacaccacccgattataagttattataagttattacaagataccgaatataagtccacgtgctattcagtaaatccttgctgcttatctattttatgggtcgtagtccgttaagaactaaagaaagacgaatagggcagatgcgaaccttgtggccgctcactggatctgcaggatctgattgacacaacacgtgtgtattatgagttagctctttgtaattatctgaagtacttacacacaaaatacttcactgaaggagaaacataagtcagactgttgacaggcataggctgtgagtctggaggacagtaatttaaggatttttcaggaattgagtggcttttatttacgtgttgctgatgatcgttgccccaccctccctccacccggttagccagggtcgtattcctggataactgctgcttctcctgttctgcctagtgctctggatatcattgtgattcctaagccagcgaatccttcaagtgattcaggggagcatgcttttctgcctgtcaatataggaaaggcttcggttcgacccagggtttacaaaatgcatttggctgcagagactttttttttaaaaggatgaatgtgaaagtcgctcagtcatgtccaaatctttgtgaccccctgagctgtagcttgcctacaggctcctctatccatgggattctccaggcaagaatgctgaagtgggttgccatttccttctcccagggatctttccaacccagagatcgaacctgggtctcccgcattgcaggcagactgtttaccgtctgagccaccagggaagcccagaaggatagataacaactagtaacatgtagtcaagttggcccatcccagaacagataggagagcagtggcctgggccctgctctgcccactccactccccaatgcctccttctgtggaaatccttcctatgcgtttatgtcacttatttcctttgcctgtgtgtatttttatgttgtcatttcatagtttagagacagctttcacaggccttccagtcgcttttctgcagcagtttgcccaaagtggcagagcttgtggggccagggctcgattctcacccagggcccttccgcgctgcccccacatgtacccggcctggctcccacctccccagacctgccacgtggggggcagctagccccgtgggtcagaacacgcggcaggtaggtgggtgctcagatcccagcaggcccaccgtccagcccctgggccccgagcctctgcctccatcacttaggttcctccgggggaatgtggaaggtggtggggcatccaagctggggccccttgagggtgggcagtgacatctgtgcactcctccccgggacccagcctcagccgagagcgggagcccaggagcgcagggcatctgtcaccctgaggcggcaccttggctttgcctgtcccctgccgtggcacctggtcaggaccactgcccttggtatcagtggagcttttgtggaaagtgaccccctggtgcccctgtctgggcatattggtggggggtggcgtcctgtggtcgggaccactgccctcgggtgaccccggggctggtggaccctcacaccgcctgtgggcctgggcccctcctggggaggcccgatacatgtgatgggggtttctgacttggaaacaatttcataagccatcctgggagtaggtaaggcaagaggggcccccagaacctcaggcccgatcctcccgggtttctgagaacctggccgctgttttctttcccccaacagacatgactaccttggtgcccccagtggcccccaagctgcaaatccagaagcctctcccatctgactcctgagtcatgcctgactttgcaccacgtccacgggtctcctctgtcctggctccctcgcagcttctggttgctgttttctcttcatcttgctgcttaaatccagtgtttcaccaagtgtgttagcatcagctctcttctctttctgttctttcttccttgtcattttatcttctctgccaaataccagcttccactctctacagataattctccagtctctgtcctgtaccccagcacccttgtttacttgcaacctgggtttctttcacctggaagtccatccagcccttcaaactcaagttttctagggctaaactcatggattcctctgccgtgtgttctgtagccgggagctggcccttcttgcagacttttcatttctattaacacagccgccagtgtatcagggttcccttcgtcactgcctctctgtcacccgaatactttgtctggtcccataccacccactcccacgatgcctcttgaatcccaactgctcccctcgtttccacagttaccactttatttacagtccccctgatagtctttgtgttcagacgtcagcttagggggcctgcagttcagttcggctctaacactgactatccagcgctcgcacagacaccatgctaaagcatgaggtccccgaccagacttccctggcagtcctgtggttaagactctgcgcttccaaaaacaaaccaaaaaaaaaagactctgcgcttcccctgcagggggcatgggttcgatccctggttgggaagctaagatcctgggattcttgccctgttctctgcacttcaccccctcaatgccgctcatattctgcgttatcaccgaggctatggtggctgtggctcagccccacagacagatcagaatcacttgggtagcaacaccacctgattctgtttgctggcgtgggtcttgtacaagaacctgattgacatctgttgagttgattggccacatcatagataacagtgcccgcaaccactttcagaaacaagtagaagccaatgtctgcatgaccatggagatggtgaatgacgccttggaccagcttcgaggtgccgtgatgatagtttatcccatggggctgccgccgtacgatcccatccggatggaatttgaaaataaagaagatttgtcagggactcaggtatgtgggtggctcttggggtctctataatgtgagttcatgcctacccctgccccagggcagaagccgctcatatttgacctcatatttatcctgatgtagtttttgcttcatacacagctttctatcttgctaggctcggcttcagagcagggttgtgaattcaggggaggaccgcagagatctgctcctggttgagggcttggcgcacacacacaggagcggcagaggagggaggagctgagaacttttcccgtttgctttgggaaatgggaagcactgggaagccaggaacctcatttttgcctgtttctgccagatgtcttggtcccattgatagagttttgtgttctagccttccctcttgctcctgaatattttcttagctttatgatccacttttgctcatttttctcatttattccttaccctgtggggcagtatcttttcctctgagccatcttacataggagggggatgcagaagcaaactgacagccccgttatacccacataggtcctcctcagcttatgatgggctgtgtcccaacaagcctaacgtaagttggaaatattagattaataaattgaaaatgcatttagtgccctcaatatcatagcttagcctcgcctgcctgaaatgtgctccagaatacttacattagccaacagttagaaaaaaatcatccagcacagagcctattttataatgtgatttactaaatactgtgccgaaagtgaaaaacagaactgttgtctggtacagaatggttgtcagtgtatcggttgactactctggtgatcataagctcaccgccacggcccagcatcccaagaagatatcacactcttatcactaggccaagaagagatgaaaattcaaaatttgaagtatggtttctactgaatgtgtatccctttcacaccatcacatggtcagtaagtcacagatgaaattgtcgtgagccgaggacttttgtattcgagcacccagcaggatccccgttttcctccctggccgtagtctaaaaatccatctcagagggaccttacatcatgcatggatgagggtgccaatgagataggatacccccacttcccagagcaggaagttacccgagtcagggcgcgagtggagactgacagggaaggtgcccaggtgagcgagggcggtgagtgggcagggaagctggtgctccctgggggaggagagggcagggcgccggaagcctgtccctcaccgggaggggcactgaccatgccaatgcccaggaagccttaaagcccgttctcaaccgtggcccccaggcagggctcaacgtcatcaaagaatcagaggcacagctgtggtgggcagccaaggagctgagacgtaccaagaagctttcagactacgtggggaagaatgaaaaaaccaaaatcatcgtcaagattcagcatgtaagcgctttgactttaatgtgtcacggctggttttttttaacttactttcacactggtaaaaatttacagtaaacctgaaagatttaaaactcccgatgcaggcactctaatcctgtttggtccaagcttaaaactgtcctctatacggagcaacgaaaactggaaggaaagggagatcagttgacagtatctggagtttgttttttctcagtttaaaaaatatattatttccttctggcggggcggtgtcttcattgctgctcaagggctttctccaggtgggctgagcaggggcccctcagtgtgctgtgtgggcttctcgttgcagagcagggctctaggtgctcaggctcggtatttgcagtatacgggctcagctgctcgtcagtgtgtggaatcttccaagacaaggcgttgacctgtgcccctgccctggcaggcggattcttaacctctggacgaccggggaagtcctcgagttccttttaattggggggaaaggagagtgtaccaagatgattttaactttaaaaatagggcttacaagtaactcaaacgtttctcgagatgaaaaatatagccccgagcactggtctcaagcttttcagagtgctgatggtctgtgaacgaggcggaaggctggagacctgtaaaggcctggtgtagagctgtgtgcctgcaggttgctgtgtcctgtgctctctcctaaaccgttctctaaagttcgggggaaacagggtggcctccacgattatcactaccccttccccactagacctgcagtggctggcttgggaatggctgtaaccaacatgcactccccagcctccactgtgagggcccagagcaagagtgagactcccttgacgatttgctttggatgatgagagatacatgacctgtttcagatcagttcagttcagtcgctcagttgtgtctgactccttgtgaccccatggacggcagcacgccaggcctccctgtccatcaccaactcctggagtttactcaagctcatgtccgttgagtcggtgatgccatccaaccatctcatcctctgtcgtccccttctcctcccgccttcaatctttcccagcatcagggtcttttcaagtgagtcagctctttgcatcaggtgcccaaagtgttggagtttctgcttcaccatggccttgtttagccatccacaaagaacagttcgggctttgggcttcccaggtggcagagtggtaaacagtctgcctgccagtgcaggagatccaacagacaggggattccatccctgggtcaagaagatccctggagtaggaaatggcaacccactccagtattcttgcctggagaatcccagggacagaggagcctggtggctacagttcacgggctcaaaaagagtggatccagtggagcacaaaacaacaaccgcagcagcaaaggcagttctaagacgtgagctgtagcctccggggtcagccacagaaggccttcacccacaacgcgctgtcccctcgtcttttcagaggggccagggagctccagctcgagagcccatcattagcagcgaggagcagaaacagctgatgctgtactatcaccgaagacaggaggagctcaaggtaccgtgggaccaatgggttttcaccagagcggacacttggggtgttcactcctctccccgatgcctcacctggggcagctgggggccatgcgtcctgcaggacgtggcggggggaccttctgagctgcagcctcaccaaggctgtgggggccctgccagtgtccctctgcgttagagtctggtggtgtcctgcttctctggggaggcggggagcagggaggttggtcgtggattctgtagaacacttccctggaatgccctcctgagcgaaacccatgtgtttctagaaactggaagaaaatgatgacgactcctgtttaaattctccgtgggcagataacactgctttgaaaagacattttcatggagtaaaagacataaagtggagacccagatgaagtttgcccgttgacgaagccttccgaaatactagctcaccgttctttaggtaaaatgacaataaccctagcttaaaacaagacagctgcgccctttgtgaacgttgttgaaatctctagttttcctttcagtttgaatttttaaaagtgagttattcaaggttttggaacgtaataaacacatcctcaaaagaatctggctaaattatttttataatctgtccactatttgaggcttttctttggctagatactggaggtatagtttcctttttcttccctgattgtttgattgtacattctcaggatgttgaaggtaccttttccgccacagtgagtcgggtccactgtgatacttggccatcagtggccactagaggccgcccgatgctgagtcttgtttcagagacggccgtgatcagtcagagggtctaaccgtagtctcccagcttcaaagcccccggatgataacctggctggccttgtcttccaggtgtgaaggccgctcctgtgagggaagttgagtggccagagcaggctagccttgaaacgggacagatccctgtgtcatttctgggcttttcccgaaaccgaacacagaccctggtgacagacggttgtccccgtgggctcagcctgcagctcccagcgtgttgagcttggcacctagactgccggaggcgagccatgttggctcggtggccatccagccacaggatgccctggctcacttgccatcccgcctggctttctggttcacctttttgagttttaaattctcccaactcatctctgcaagtgtggatgcttctgcagctcaaggacacctctcaggctgtgccgccaggggcggcccacacatctggtcctgcttcatttggcccatagaggactcttctcccagcaggaggaaaggcatcgtgctcactccgaggaggagctaagtgacacggatgctccctgccctggtctcccttgtgcccactgctgtgctagagcccaaggcaggagccgggaccctcagttcccaggcctggtcccgtagtgttaggcagggactggccaggtctgcccctgcccttcacacgccagcgaggctcgctcagactcttgtgggttgccatctcctcccagagctgactacctactcgcatttctgctgttcttgagactgcatcttctaaagtggcttgtaacttgactgtaccttactcttgattgtcaaattttgtataatcaagtttgcattggttttcttgttgacttccattcttttaatttttattgaagtatacttgacttaacaatgttacttttaggcgtaacattcattatgatcttaaacgtctccgtggagagcttgtgtccttagatgatataaagtttgcagtaagatcctgtgacttcacttgagaagcacccgctctaatcaatgtctagttgatgtgcaggcatgacagccacgctcgacttgcaaataaacgttaagccacatgatcacagtagctcttcttaagaatcactgtttccacgtcattgtgaattctgcacttccctggtggcccagtggtaaacaatctgccgccaatgcaggagacacggttcagccctgattcgggaggccccgtgtgctgcaggaccactgggcccagggaacacagccgtttcacctgttgctctagagcccaggagcggcatctgctgggctcacatgcccaaatgctggaggccacgctccctagagcccgtggacctcaactagagaaaagccagagcagctacggagacccagcacgtaaataaaactattaaaaaaaaaaatcacaccacactccttttattggatactgacatgaaacaaacaataacctctctgcctcataaccccctgagctctatccatcctgaagtgtggaagtgaaagtcactcagttgcgtacaactctgcaactccacagactgtagcccaccaggctcctctgtccatggaattctccaggccagaatactggagtgggtaacttttccctcctccaggggattttcccaacccagggatcgaaccaggtctcctgcattgcaagcagattctttaccagctgagccacaagggaagctcaagaatactggagtgggtagcctgtcccttctccagtggatcttccctacccaagcattgaagcggggtctcctgcattgcaggtggattctttaccagctgagccaccaggaaagcccccaccacacccccaccctgaggtctgtccttcctgaagtcgccccttacaagcactgcagccaccccttcatggtcatctgtctataaggaaatgaggtgggccatcccggctcactctgtgcttctgtaggttgattcccttcatgtcagcccctgaggaagctgctggtgacctcagatgggtcatttttggtcatgtcgctagtaaaggtagagggacttccctgatagctcagggatgggctacccattccagtattctggcctggagaatcccatggactttatagttcatggggtcacaaagagtttggacacgactgagcaactttcattttcacttcaagggtagagagtcaagcgccacacccaggacttcccaagaaatcaacttagcggaagtcatcttgccaaacagcagtctatgaatcagcttaagcattaagtcttgatgtgactttttatttttaaatcccatacatctgtggatcaatatcaaggaaacgcagtgtctgctgtctgttgggggccagactgggtctgtgatctcatgctatgtaacttgtcttctcacatgattgtttcttctttcaaggagaccaggaatgctcataataaaatttgacaccaccccatgccccttcagctggcaaactgaaaccccaggcagtatttctgtcacagaattacctagttccttgccaactgctctgtgaagaaagtgccatcaagcttggaatcagctgccacaatcttaggcagttttgttgttgggcagtcactaagtcttgcctaagtctttgcaaccccatggactgtagcacaccaggcttccctgtcctccactatcttctggagtttgctcaaactcatgtccattgagtcggtgatgccatccaaccatctcatcctctgttgtccccttctcctccctccttcaatctttcccagcatcaggggtcttttccaatgaatcggccaaagtattggagtttcagcttcagcatcagtccttccaatgaacattcagggctgatttcctttaggatggactggttggatcttcttgcattccaaggcactctcaagagtcttctctaacactacagttcaaaagcatcaattcttcagcactcagctttctttatgttccaactctacatccatacatgactactggaatagtctatgtatacctagatgctaaacaatgtgctagtgaacttcaggaagggaaggtccacagaacatacatctgcgaagggccccaaataggggtgccttctccagaacaggcagacagcagccatcgattattttagtgtctgaggccaacagtgatggggccacgggtcctaagtctgctttggttcaccaaccacagaaaagggggagagagaattgagcccttttttttttggccgtgaggcatgcagggtcttagtggcccaaccaaggattgaacccacgccccctgcagtggaagctcagagtggagtcttaaccactggaccaccagggaagcccaagtgagcccatccttgagatgctttaaacaaatagacacttggctcgactctgaaaccactgccctgagtgattaataacaagtctggggttgcgtcccagctggaggagggactccagcctgctggcaggcctagcacacgccggtcacaggactctgcccttaggatcctgggccacactctcatggcagaggttagcagatgaataaattcccacaggctgaagctgagtctgtcattcctttgaatagactgaactctgcgttcagaataaggaaacaagcaccacagctggcttgctattccagtcacagggcaggattccaagacgccgtgagccagcatcatcactaaaggcagaatgcaaagcaccaaaaaccccgtttgcagttttgtcactgaaacccctgatcctacaaccggccttgctcagcagccgcataaccacagctgtgtccctgccttggccctgacccctccgctgtttacactgtgccggaccaggtcctcgaggctctgtgtgtttcagtagtaaattagcaaaataaaaaatgcgctcctgctgggaattccctggatgcccagtggttagggctctgtgctttcactgccaagagcctgggttcaatccctggtcagggaactaggatcctgcaagctgtgcaagtcaaagctatggtttttccagtggtttttcctatggtttttccagtatggatgtgagagctgggccataaagaaggctaagcactgaagaattgatgctttcgaactgtggtgttggagtagacacttgagagtcatttaaaggatagcaagaagatcaaaccactcaatcctaaaagaaatcaattctggatattcattgaaaggactgatgctgaagctgaaactccaatactttggccacctgatgtaaagaactgactcattgggaaagaccctgatgctgggaaagattgagggcaggaggacaaggggatgacagaggatgaggtggtttgatggcatcactaactcaatagtcatgaatttgagcaaacttcgggagatggtggaagacagaggaacctggcatgctagagtccatggagtcgcagagctgaacatgatttagcgattgaacaacaacaaagccacaccaagaaaagttcctgctgtcagaatcttatattgaaactaaatcacttatgattgtaaaataaaagagatgggggtaaaactgctaagggaggtaaaactgtgtaaatcagcccccaaaactgagagctggtctgagtttagctgttgctgctgctgctaagtcgcttcagtcgtgtgtgactctgtgcgaccccatagacggaagcccaccaggatcccctgtccctgggattctccaggcaagaacactggagtgggttgccatttccttctccagagtttagctgttagaccctcacaaactgaactcagctcacctgaacagatgtccacattttcttgcaactatttccaagtctgaaaatgcttggcatttctagaggtaacttagtattgatctgaggagttttcaggtggcatggctgttgatttttccttggaaggtaaatctgatttaatcattgaatatgggattttattacctttatgctaaaggaactgcaaggagatccaaccagttcatcgcaaaggagatcagtcctgggtgtacattggaaggactgatgttgaagctgaaactccaatgctttggccacctgatgtgaagagctgactcatttgaaaagatcctgatgctgggaaagattgagggcaggaggagaaggggacgacagaggatgagatggttggatgacatcactgactcgatggacatgagtctgagtaaactccaggagttggcaatggacagggaagactgcgtgctgcagtccatggggttgcaaagagttggatacaagtgaatgactgaactgaactgaactgaaaggaagtaaaaaattgacaaacatcaaaaaaataaatgacacaaattgaccattgaaaaagtgaaagtcatttagtcgtgtccaactctttgcaaccccatggactgtaacccaccaggctcctctgtccttgggattctccaggcaagaacactggagtgggttgccatttccttctccaggcaaccttcccatcccagggattgaacctgtgtctacctgcattgcaggcagattctttaccatctgagccaccaaggtacagaattcaccgtgtataatagatcgtctacattttttagagaaaacattttagggacaggcatttataatggactgtttccatcagcacagttgaaatggggcagcaggttctgtctgttctctgaggcctccctccagtcctgtgtttctcaaatagaaaatctccccaaaccttcgtagaacgtttttcaaataggagaggatgtctccaggaagtgtcctgctgtgcgtgtggagctgaggtgtgcagaggcccacgctacccccaccccaaggatgtgccttccagaagcggggtgacacccttccccacgaggaggtgtggagaccgaaacgccaacttagaccggcagcgtcaaatgggccgcaagtaatgttcctacagagctttcctcactccagtgaaacgtcctgtcttcccaaggccagctcatccatctgccatctctgcaccatcctccctgaggccaagtggccacttccggtcacctgtgggaaccgacggacctggcctggtgagggcaagccctacgtcaaggcctagggaacccagagcatcttccagtcagaacccaattatcaggctaaatttatttcttttttgctacttttcccatataatttctctaagccgacatgttgtattttcatttttactcactttaagaaattgtcttttttttttttcttttagctgtgcggtgcaggaccctggtcccctgttcagggatcaaacccgtgccctctgcagtggattcttaaccactgggccaccaggggagtccctgtctttactttaaatgcctgtacaaggggacttttaactctgcgattagtatgtgctcagtttttaaaacattggggtaaaataggaaacaagtaaagaaagaaactaaaaataattctaatactaccacccggggagaggatgtcaacttttttttttttttttttaccagaaaaatggaaatttatcctgaaagtgcagaaaataaaaatcatgatgaacccccaagtatacaccattcagtttcaaaagtgatcagtgttctgctgatcgtgttccctctgtcctcccagggtacccattctgagatctttccaaaaaaactcccagatatcattttacttcacctgtaactttcactgcatctaacagatttgcacatagaggatcacaaagaaaattttaaatttcctgaagtataaaaatgcagctagcattgtccgatcacagtgcaaacaaaacaaaacacaaacctcctagaaattcacattaatatcaaaaccaacaaaaggccctcctcctgtgcttccctggtagctcagttggtaaacaatctacctgcagtgcaggagacctgggtttgatccctgggtctggaagatcccctggagaaggaaacggcaactcactccagtatccttgcctggaaaatctcatggacagaagagcctggtgggctgcagtccatggggtcacaaagagtcaggcacgactgggcgactaacacttactataagctacttgtaagacacagatttttctaaatgaagttgcacaacttctagaaagtaatggataatgaaaaagaacatgtcaatttatgagtctactgaagcaggatctagaaaaatatacagaaataaatatcagaaaccataaaaatggaaataaatcaattaaatggctaagcaaggaactagaaaaagaccaagagagtaaaacaaagaaagcagaaggaaggaattaatgaagttcaaactagaaatttaatgagttatgttattaatacatcaaaaaacagtagtttaaaaaaaatcaacaaaattggaaaaacattagctggtataatttaaaagaagcaaaccacaaatacacaatgtaagaaatgataagaggaaaataattgaagggaagaattttttaaattcagctaatatttttttactagtttcagttcagtcgctcagtcgtgtccagctgtttgcgaacccatgaatcgcagcacgccaggcctccctgcccatcaccaactcccggagtttacccaaactcatgtccatcaagttggtgatgccactgagccatctcatcctctgtcgtccccttctcctcctgccctcaatctttcccagcatcggggtcttttccaatgagtcaactcttcgcatgaggtggccaaagtattggagtctcagcctcagcatcagaccttccaatgaactctcaggactgatcactgatctcctttaggatggactggttggatctccttgcagtccaagggactctcaagagtcttctccaacaccacagttcaaaagcatcaattcttcggtgctcagccttcttcacagtccaactctcacatccatgcatgaccactggaataaccatagccttgactagacggacctttgttgccaaagtagtatctctgcttttgagtatgctatctaggttggttataactttccaaggagtaagcatctcttaatttcatggctgcaatcaccatctgcagtgattttggagcccaaaaaaataaagtctgatgctgtttctgctgtttccccatctatttcccatgaagtgatggaaccagatgccatgatcttagttttctgaatgttgagctttaagccaactttttcactctcctctttcactttcatcaagaggctttttagttattcttcactttctgccataaaggtggtgtcatctgcatatctgaggttattgatatttctcctggcaatcttgattccagcttgtgcttcttccagcccagcgtttctcatgatgtactctgcatgtaagttaaataagcagggtgacaatatgcagccttgatgtactccttttcctatttggaaccagtctattgttctatatccagttctaactgttgcttcctgacctgcatataggtttctcaagaggcaggtcaggtgttctggtattcccatctctttcagaattttccacagtttattgtgatccacacagtcaaagtctttggcatagtcaataaagtagaaatagatgtctttctggaattctcttgcttttttgatgatccaggggatgttggcaatttgatctctggttcctctgccttttctaaaaccagcttgaacagctggaagttcacggttcatgtattgctgaagcctggcttggagaattttgagcattactttactagtgtgtgagatgagtgcaattgtgcagtagtttgagcattctttggcattatctttctttggaattggaatgaaaactgaccttttccagtcctgtggcctactagtttaggcaaataaatttgaaaacctagatgaaatagatacatttttaggaaaataaaatgtacccaaatagagatagaatatgtatacagacaacttcgatagaagacagacagaaaattctaaatttacaggcacagactcatcaggggactctatgaaacctttaaagaccaattaattgcagatttgcataagtttgcagcaaattgaaaaagaatgtaagcttctaagttacttttatgaagctaatataatattactaattgcaactgacagagtcctatattactaataaatattaatgcaagtttaaaaaataaaaatataaggacattgaataaaaagtacattaagtatggcatttcatgtcccagtaggatttattccagaagggcaaggatggtttaatagtaagaaatctatcatattaacagagctaagaggaaaatcacaggatcatatccatagatgcctacaaggcatttgacaaaattcaagtcccatgtgactggctgtaaaccacaaaccacactatacagatgatgctcatccttccacacttcatcctgctttcagatactcttccaaaacatgacagggatggaattccagggtggtgctctggagccccctctcccgggggaggctgagtatggaggatgaggtaggggagctaaggggagacaaggaagcagggtcaaccccaaacatgcaagtagctgaggggaaaacgaagacccagagtccaagatcaaggtgccagcaggtttggtgtcttccaaggcctctgtggcttggcttgcacccgccaccttctctctgggtccttaaggttgttctgctgtctacacacacttcctctccctataaggtatcttaaaggaaggtgtctcttcctctccctataaggacgaagagccgactcactggaaaagaccctgatgcatcaccaaccaaactgacatgagtttaagtaaactccaggagatagtgaaggacagggaagctgggtatgctgcagtccatggggtcacaaagagctcaatgcaactgaataaaaacaaagacaccagtcttactggattagggccccacccttatgacttagggattccctggtggctcagatgataaagaatctgcccacagtgcaggagacagggttcgatccctaggtcaggaagatcccctggagaagggaatggcaacccactccagtattcttgcttagaaaaccccatggacagaggaggtcggtgggctacaatccatggaattgcagagttggacagagtgactaacacttctccacttatgactggtgtaagccgtaagccctggaaactaggttttctctttcttgtaatgtgagtgcctgacttaagctttgattgaataaatacactgccagccacgggactagataaagagccaaagccatcttcccccactgaggctcttttgttttagagatctttctaaagagcttgttttttctcttctcttcaagttcccactcttatgttttgaactcagcaatagtgagcccatgaaaccctaggcccccacccttgaccccagtataagcagaaccctggacctgtgttcacactctttctaccacagcctcgctgtctgcccccaggggaaaccatgtaatttctgggtccttcaaatagtagttttgtttttttctccaatttcctgatggttattgctgcagtgtgtcttgcaatcataaccacaacggctggtccagccacaacaatggttattagcagctgagaccagcacacaacaatgacctcatttaaccgacctcatttaaccttgtctccagatgcagtcacattctaagatgctcaaggttcaggcttcaccacatgaattttgggaagacacagttcagtccatagaggctagaggagctgtcatttaagagctgccaggccttagataattttattaacgttataagcttcagtttccttcacaaaagaaagtaaaaacattgtctatttcatccattaagatgacgcacgagatgtgggttccatccctgagggggagagaccccgtggagaaggaaatggccacccactccaatatccttgcctaggaaattccatgggcagaggagcctggtgggcttcaatccatggggtctcgaagattcggactggctgagcacacacacatatgcaccaaagacatagtcacagtaatttcgttaaaatagaggtaccgtttttctcatataacaggaggttggaggcagaaagtttgggattggtgcagctgaggacccaggctccttctgccttcttactccatcatccggggcttgaagctttctgcttttatgcctgaaagttggctctcatgtctttaagcgcccgacctatatatcaggcaggaggacagaggaggggcaaaaggaggaggctacaatgtgggtgccacttgtgtctgctccctcctgaaaaagtccccaggacctctttccttcatatcacgttggctagaactggttgttgcatccttgttactacctattaaggggtacagagtagtcagtacttcagccaggtgtgttactaccttgaatacaattggagttctgctggtaaggaagaaagggagaatggatattaaatacttaaccaatcttatctgccacatctaacctcaaggttgttgaaggattacttgagatgatatgtttgacagaagacataaataaacagtgtgatggtataaaaacttagccgttaattcaagacacaaggtcctaaaacatcaaatgtgtaaaatgaaggatcgcattattgcacgaccaatggaaggaagaggacagcagtgggcagccaaaagtgaaagaaagtgaagtcgcccagtcgtgtcggactctttgtggccccatggactgtggcccgccaggctcctccacccatggaattttccaggcaagagtactggagtgggttgccatttccttttccaagtgggtgatcttcctgacccagggatcaaacccgaatctcccgcattgcaggcagatgctttaccatctgagccaccagggaaccagtccaagcaattctccaggccagaatattggagtgggtagcctttcctttctccaggggatcttcccaacccaggggtcaaacccaagtctcccacattgcagatggattctttaccagctcagccaccagggaagcccctgggcagccaaatggctgagcagttcagggtacaaaggctctatccatgcccatcctggtcaaaattgagatgtgagacatccatgtggtttccgatgctttgaccgtgggcttttgctggccctggagggacttcccgggttagctgattcctagagacaacaatcagttctcctgggagcagagctgttgggtacaaagcaacgaatcccgagtccaccccaatcactgccttcgctgagctctcaaagggctctcacactcagggccacttatccctctgccctagcctgggtaccacacagccctggcctccggagttggctggaattattcgcaatagccagtcccaagcctgcttaccctgcttcgcccattccttctagttagaccacagtaaaggctgtttctcacttctcccacgcactccttccaactcctgatagaccctggtgcttccccgtgtggctctgcatggggccgtgtgctcccctctcctcttgggaactgtgaataatgagctgcatcttttcagaggccgttgtcttctcatctgctggctttgctggccccaagtaataataaaacctatgttttaacacaaaaggattacatttaggcaagaataggcactttagagaacagctcatgcctgggaaagactcatgcatcggaaggactgatgctgaagctgaaactccaatactttggccacctgatgcgaagagacggctcactggaaaagaccctgattctgggaaagattgaaggtgggaggagaaggggatgacacaggatggattgttggatggcatcactgactcaatggacatgtttgagcaaactccgggagatagtgaaggacagggaagcctggcgtgctgcagcctgtggggtcacaaacagacaacttagcgacctaacaacaatgtgcctaggggtgtggctaagatcctggcatgcagcttggcttcaggtgggctacctgcccccggcagggtctgaaggtgccacttctttttccatcgagacaggattcggggggggcgggggtcaccacgtgggtgcctgcccctgcctccaggggtggcccttcttggcagctaccccccaccttgctatctgacccctgccttattgcccagccctacccacctcactgcaccccagtcacgaggctgagttgggtacatggccagaccttcggcttcccagagcgcaggctctagctgaacccatatttggggaacagagtgaggaggaaagctgctaagtttagaaactcaaagaaaagttccgcagcctgtgaacccagatgcgttcagtaagaggaagtttatataaagctgtgggaaacatggcacttccttggatacaaacagcccagttacgcatgagcccgagaccttgctgtcttgagagtgagtttcaatagctggagaccaagccacctcccagcaagaacgtgggtggctgggtgaggtcagggggactggctggttctccgcggctccagtcctcggcgtgggggaaccagacgctccctgaacagatggagctgggctggctgtggggaggtcatcacacagctggcccagggtgataaacagaaccgtgggttacatggggctgctgctgctaagtcgcttcagtcgtgtccgactctgtgcgaccccattgacggcagcccaccaggcttccccgtccctgggattcaccaggcaagaacactggagcaggttgccatttccttctgcaatcacccgtggggcagaacctcccaaagtcacagctccaccctttctctggagctaattattcatcaccttcgagtgcccggccagccgccatgatgttttccagtctggctcggggaacgggcacctctagtcctcgtagagctctggatgtagttccttctaggcctttcccgtggttttctggtcctgggttcgggtggttccctcacaagcacatgtgacgagctctcaaccacattctcaagggggcctctgctcacctccgggttctccctgcctgtgcccgcctcttatccctgacaccctggccctgcagctgtggtccccttggtctccctagaccctcatctctatgtcttcaactcaggtggcccactggggcccccacccctaggttgcccctttcctacgctgcccgcaaggcaggggagttagggaagtgctgcccctcctcgcctgacatccaatgtcttaaagatggtgtttcacatatgtttaaaagaatttggttatttcaggtggcagggtggaggaaggacactcatcagtggggctggatacgaggtactcctcacacttgggaaataaccgcttatggttctctgggtggccaggaaacatgatgccagcccctagtcgccatcttctttactggggctgccgttcacagcagctcaggttgtgcactgcacaaatgctcctggctgtgtgggagctgagactcagctcgcagctgcatctccttagagaaagcaatttttcttattttccacaaacactgtcctatgactgagccatgtatcagggactccatccatctagaggaaggacactttttgtcattgtcacagtggcaacatctgggccagtggggactcttaacttgtcccacctgagactccttctacatgggtggcttactgagtttggggaagctggattatgcaaggacacttctttcttttaatttttatttatttatttgtttttggctacgctgggtcttcattgctgcatgggcttttctccagttgctgtgagccagggctactctctagctgtggtacccaggcttctcactgcagtggcttctcttgttgctgagcacaggcacttgagctttaggagttgaggcacatgcactcaggagttgcggttcccaggctctagagtagcagctcaatagttgtggcacatgggtttaattgctccatggcacgtggaatcttccccgaccaaggatcaaacccatgtctcctgagtgggcaggcggattctttaccacattgagccaccagggaagccctgtgcatgatggcttctaataactggtctgaattcatgagcgatgggccaagtcctgagcttgactctctgacattgtcaaggatccttcagtgattagctggatgtcagaataaatagagactgacagggaccccgtagtgctggccctcatccctggcatgatgaaatagagtggactcccacttgaattggctgggagacaaatttaatgtcttatttttaccatttaaatagcagcccccgtgtgtcccacctccaggctgctctggggaagcataaatcacccttagatcagccacctcagagcactttgcttgcatatcattttctagcttagcttgtccagagcccagcaccaggcgcatgtatgtgtcccagttcttcctgacccatgaccttcatcttcttccttataatgtgtgttagtcattcagccccgtccaactctttttgaccccgtggactgtagcccaccaggctcctctgtccatgggattcggaggcaagaatactggagtgggttgccatttccttctccaggagatcttcccaacccagggactgaacctgggtctcctgcattgcaggcagattctttaccacctgagccaccagggaaagagtctttcttataatacaggacagtaactgtaacaattgtgcggtagtgtgagcattctttggcattgcctttctttgggattggaatgaaaactgaccttttccagtcctgtggccactgctgagttttccaaatttactggcatattgagtgtagcactttcacagcatcatctttcaggatttgaaatagctcaactaaaattccatcacctccactagctttgttcatagtggtgctttctaaggcccacttgacttcacattccaggatgtctggctctaggtgagtgatcacactgattatctgggtcgtgaagatctttcttgtacagttcttctgtgtattcttgccatctcttcttaatatcttctgcttctgttaggtccataccatttctgtcctttactgagcccatctttgcatgaaatattcccttggtatctctgattttcttgaagagatctctagtctttcccattctgttgttttcctctatttgtttgcattgattgctaaagaaggctttcttatctctctttgctattctttggaacactgcattcagatgcttatatctttccttttctcctttgcttttcacttctctccttttcacagctatttgtaaggcctccccagacagtcattttgcttttttgcatttcttttccatggggatggtcttgatccctgtctcctgtacaatgtcacaaacctcagtccatagttcatcaggcactctatctatcagatctagtcccttaaatctatttctcacttccactgtataatcttaagggatttgatttaggtcatacctgaatggtctagtggttttccctactttcttcaatttaagtctgaatttggtaataaggagttcatgatctgagccactgtcagctcccagtcttgtttttgctgactgtatagagcttctccatctttggctgcaaagaatataatcaatctgatttcggtgtcgaccatctggtgatgtccatgtgtagagtcttctcttgtgttgttgtaagagggtgtttgctatgaccagtgcattctcttagcaaaactctattagcctttgccctgcttcattctgtactccagggccaaatgtgcttgttactccaggtgtttcttgacttcctacttttgcgttccagtcccctataatgaaaaggacatcttttttgggtgttagttctaaaaggtcttgtaggtcttcataggaccgttcaacctcagcttcttcagcattactggttagggcatagacttggattaccttgatattgaatggtttgccttggaaatgagcagagatcattctgtcgtttttgagattgcatccaagtactgcattttggactcttctgttgaccatgatggccactccatttcttctaagggattcctgccctcagtagtagatataatggtcatctgagttaaattcacccattccggtccattttagttcgctgattcctagaatgtcgacattcactcttgccatctcctgtttgaccacttccaatttgccttgatttgtggacctaacattccaggttcctatgcaatattgctctttatagcatcagaccttgcttctatcaccagtcacatccacaactggatattgtttttgctttggctccatcccttcattctttctggagttatttctccactgatctctagtagcatattgggcacctaccgacctggggagttcatctttcagtatcctatcattttgccttttcatactgttcatggggttctcaaggcaagaatactgaagtggtttgccattcccttctccagtggaccacattctgtcaaacctctccaccatgacctgtccatcttgggtggccccacagggcatagcttagtttcattgagttagacaagactgtggtcctaatgtgattagattgtctagtttcctgtgattatggtttcagtgtgtctgccctctgatgccctctcacaacacctaccgtcttacttgggtttctcttaccttggacgcggggtatctctgcacagctgctccagcaaagtgcagctgctgctccttaccttggatgaggtcacccctcctgaccttgaatgtagagtagctcctctcggccctcctccgccctcgcagccatccctccttggacgtggagttgctcctctcggccgccgctcctgacctcggacgtggggtagctctctcgggtgccgcccctgacctcagaagatgatgctgtgaaagtgctgcgcacaatatgtcaacaaatttggaaaactcagcagtggccacaggactggaaaaggtcagttttcattccaattccaaagaaaggcaatgccaaagaatgcttaaactactgcacaattgcactcatctcacatgctagtaaactaatgctcaaaattctccaagccaggcttcagcaatacgtgaaccatgaacttccagatgttcaagctggttttagaaaaggcagaggaaccagagatcaaattgccaacatccgctggatcatcgaaaaagcaggacagttccagaaaaacatctatttctgctttattgactatgccaaagcctttgactgtgtggatcataataaactgtggaaaattctgaaaaaaatgggaataccagaccacctgatctgcctcttgagaaacctatatgcaggtaaggaagcaacagttagaactggacatggaacaacagactggttccaaataggaaaaggagtatgtcaaggctgtatattgtcaccctgcttatttaacttacatgcagagtacatcatgagaaaagctgggctggaagaagcacaagctggaattaagattgccaggagaaatatcaataacctcagatatgcagatgacaccacccttatggcagaaagtgaagaactaaaaagccttttgatgaaagtgaaagaggagagtgaaaaagttggcttaaagctcaacattcagaaagctaagatcatggcatcaggtcccatcacttcatgggaaatagatggggaaacagtggaaacagtgtcagactttatttttgtggactccaaaatcactgcagatggtgattgcagccatgaaattaaaagacacttactccttggaaggaaagttatgaccaacttagatagcatattaaaaagcagagacattactttgctgtctagtcaaggctatggtttttcagtggtcatgtatggatgtgagagttggactatgaagaaagctgagcgctgaagaattgatgcttttgaattgtgatgttggagaagactcttgagagtcccttggactgcaaggagatccaaccagtccatcctaaaggagatcagacctgggttttcattggaaggactgatgctgaggctgaaactccagtactttggccacctcatgcaaaggaaaagactcattggaaaagactctgatgctgagagggattgggggcaggaggagaaggggatgacagaggatgagatggctggatggcatcaccgactcaacagacatgagtttgggtaaactccgggagttggtgatggacagggaggcctggcatgctgcgattcatgggtcgcaaaaagttggacatgactgagcaaatgaactgaactgaactgaacctataacaaagtctgctgctgctgctgctgctgctaagtcacttcagttgtgtccgactctgtgtgaccccatagacggcagcccatcaggctcccccgtccctgggattctccaggcaagaacactggagtgggttgccatttccttctccaatgcatgaaagtggaaagtgaaagtgaagtcgctcagtcgtgtctgactcttagcgaccccatggactgcagcccaccaggctcctctgcccatgcgattttccaggcaagagtactggagtagggtgccattgctttctctgacaaagtctgctatgtgcctccaaattctttccttttctcctagcaaaagagcactattttttttttaattggatacactgctgccaagtaaaacactacatcccctagtattttctacatccaggggtagccagataataaagctttggacaaagaaattaaagtgaaggggtggagatatcactgtctctttaaaggtgacttcctcctcttctcttttctgtcacccagaatggagaagtaatggctggagctccagcagtcatattggactatgagatgaccttagaaaagaaagccatgtgtgttaaagcagtgagatagaaggagcctgggtctgtaacatcatgggccaccataccaggcagtaatggatatttgtgttcttctgtatagattaagtcactattttcaggacaaagttgcttgtaggtgaacccagtctaattggtatagcaacacaaccatagtaacacaacccgtgtcatcttcctttcacagcctgatggcctcattcctgcaatgcttagcaatgtaaacaagagaaatcaagagtaggaattgatgaggttgcctccggctctggaaaactgagatccactgagccagtgctttgtgctggagtgttgaaagacagaagggcacgcgcctgacaaagaaaaacagaggaacacttcaaagagtctttcccgagttccatgctcaaaaaaaccccgagccagatgctgcagcaaggcattgtcagatagacaaatgtgggaatggcttattgctcctgaatcaacgtccactctggcaacttctctttttcctccaccgagcgttttctgccagaaattttttcttttttttttggttgttgtatgtttgttttggccatacttcacagctcgcaggatcctagttcctcagccagggtttgaacctgggccccctgaaatggaaacgtggagtcctaaccactggattgccagggaattcccttggcagttttgaaacggtaagtcaccacctcaagcggcatttggccatttaactgagagagaagggacagtgagacctgatcacggagtgggtgactatagaaggcggatggggagtaagtttggaatagaaagaaaaatcttttaactccagagctgtggtgattgagcagcacccctgatctacagagatttcggattaggcttttctggctcttgcttgtgatggtagcaggcaggggagcctgggtgaagaccatgggctccatgttcaaatcctgacaccaccacttgctggctcccaaatccaaacaggctgctttacttttgtctgcctcgaggtcctcatcttaaaatgggaatgacaatacacctaattccatagggctgtcatgaagatgaaaataaacactccctttaaaagcacttaacatggcacagagaaagagtttcagaatctcagttatttgttcacagtttcaggaggtgcgatttcaggacagtcaaacccaccagaaccaaatgataattgagttctcctggacagagggatggacctggcatatcatagcctcaatctcagaacacaagctccccaggaaagatgtttgtcagatttgggtccagctggggtctctcttgtagtgcctgctacaggtcaaatgttaatagaaaattgtcaggggaaaaaaaaaaaaaaactaagaccaaaactacccgtatgacccagtaatcccaggactgggcatataccctgaagaaaccataactgaaaaagacacaggtaccacaatattcattgcagcactatttacactagctaggacatgaaggcaacctagatgtccatcaacagatgaagggataaagaagttatggtacatatatatgacggaatattactcagccataaaacagaacacatttgaaacagttctaatgggaaagtgaagaagaactaaagagccccttgatgaaagtgaaagaggagagtgaaaaggttggcttaaaactcaacattcagaaaactaatatcatggcatctggtcccatcacttcatggcaaatagatggggaaacagtggaaacagtgagagactttattttggggggctccaaaatcactgcagatggtgattgcagccatgaaattaaaagacacttactccttggaagaaaagctatgaccaacctagacagcatattaaaaagcagagacattactttgccaacaaaggtcatatagtcaaggctatggtttttccagtggtcatgtatggatgcgagagttggactgtgaatagagctgagtgccaaagctgatgcttttgaactgtgatgttggagaagactcttgggagtcccttggactgcaaggagatccaaccagtccatcctaaaggaaatcagtcctgggtgttcattagaaggaatgaaggatgctgaagctgaaactccaatcctctggccacctgatgtgaagaactgactccttggaaaagaccctgatgctgggaaagattgaaggtgggaggagaaggggacaacagaggatgagatggttggatggcatcaccgactccatggacatgagtttgagtgaactccaggagttggtggtagacagggaggcctggtgtgctatggttcatggggtcgcaaagagtcggacacaacttgaactgaatggggaggatgaacctagagcctattatacagagtgaagtaagtcagaaagagaaaaacaaatatggcacatcgatgcatatatgtggactctagaaagatggtacagaggctcctgtttgcagggcagcggtggagacacagatgtggacagactgtggccacagcgggggcagcagagggagggacggttcggaagggtctcatggaagtgtatagattaccatgtgtaaagtagagagccggtgggaatttgctgtatgacgcagggagatcaaacccagggctctgtgacaacctagagggctgggatggggtggggggtgagagggaggctcaaaggggaggggacatatgtatacgtgtggctgattcatgttgctgtatggcagaaaccaacacaatattgtaaggtaattatcctccaattaaaaaaaaaaaaaaatagcagctgttgaatgaggaacttcactagaatgtagagtgtccagggccccgtaatctgcttggggaccatcctgggtggtcccatcgtgtcctttgttcccatttttgatggtcccaaggagccacagagtatgtagccgtctctcacgctgacccgacatccttccattaggctctcgagagcctgtggaacagtcacagaatccctcgtacactcagcctccccttcagtgtctccttctgtgtgaaagtgaagttctcagttgtgtccggctctttgcgactccatggaccgtagcccaccaggctcctccgcccatggaattttccaggcaagagtaccggagtgggttgccatttccttctccaggggatcttccccacccagggctcgatcccaggtctcccgcactgcaggccgacgcttcaccatgtgagccaccagggagactgtctccttccttgcatcgcatcgaaagcctgagtcagaatacacaaaatctgtaatgtgcagaataaaatataaacaataatatgttcatcagagtaatcaagattaaaagctataactagtatttacagagttccttaaaaaaaaacaatgttggcgatcacgcatggattaaaggagtatttgtggatttttttcacataagctcaaataaaaagagaaagaaaacagaataaaagagaaagaaagcctggctctcccatgagcatgctctctgcgcggctgtgaagtgggggccagtttctcccccataccccgatttccagatggctataggttgatgttcccccaggtcattctagatcataaccctccgttccccctcagagccctgcctctgacacctcatcacctctcggggtcttcagatggctctgttagcccccctcagcacccccacatctgagcagccaccctcagcacccccacatctgagcaccccctcacaggcctcagggcgcatgaaaccaccctggcaggtctctctccctggggcccattcgtttggcaaaacccccaaccgtcgttaaaaccaacattccagcagcatggcagagagaaccccagaatcacggtcatggggggcgccccgggtccttagattctccccctccacagctgcatcacacctcctctctcagcagctccctgccctccgccctgacgtgtcttaccctccagtttacagagaaaacagacaccccccgcccccactgcagtggacagaccgtccaggctcccacgagccaccgtgggctttgttccccacccaggacaccactctggcaggaacccccacctcctccacagcctcatactccccacagcatcacccatcccactgatctctcactatggaatagtccctatcttccaggagacttccctgtagctcaaacggtaaagaatctgcctgcaaggcaggagaccaggggttcgatctctgggttgggaagttcttctggagaagggaatggcaatccacctcagtattcctgcccggggaatcccatggaccgaggaggctggcgggctacagtctatggggccgacctatcttcaagcctctctttccacgtaatgaatttggcatcagaagtatctcttctctttagggcttcccaagtggtcctcatggtaaagaacccgcctgccaatgcaagagacacaggagatgtgatgtttgtatttaaaaaatagtatcacagcgtattagttagggtcacgtgacaaaaaggcaacattccagaggctgggtacgatagaaatatattgctccctgtgtaagagttctgcggatgtttctggttagtggacagtatttctccagtggtggttcagtgactcagcgatgggttcctcccatctagtgggctctactggctttcccaggatcttgaagggacttctggctggtggagatgaaaagagaaagtggagaacgcacagtgtctcctcactttccctggaggtaggcacctcccctccgctcacattctgacagccagaggtagactcacaacttcacgtgtcaatgaaatgtgtgtgcaggaggccaggtgggggttggaagccaccctccatgtgccgatgggcattcttgttgtagtcatcagctgaagttagagctatgcttatgcgggacgttttggtaaatatctgtgtgtgttagtcattcagttgtgtctgactctttgcaaccccatggactgtagcccgccaggctcctctgtccatcggattctccaggcaagaatactggagtgggttgccatttccttctccagggatcttcccgactcagggattgaacctggatctcctgcattgcaggcagattctttactgtctaaatcacaagggaatccctggtaaatatataccagattctaaagtatacatatcctttgacctcataattccacttctggtgatttttttcctacagatatattcacaaatgtgtatagatgtatgttttaaggatgtacttagtatgtttgtttcttgtggctgctgtcacagatgaccacagtgaaagtgaagtgaaaggttgctcactcttgtcaaactctttgtgaccccatgaactgtagtccaccaggctcctctgtccatgtgattctccaggcaagaataccagaggggggtagtcacagaattggtggcttaaacatcaaaaatttattatctcacattttggaaaccagaagttcaaaatgtgtgtcctggagcccaaaatcaaggtgtcagcaggtttgtgcttgctgagggctgttggagagaatcctcccttgcatagggtccccccttgcaatccggtggtgaggagtccctgcttccagtgcagggggtgtaggttcgatccctggtcatggaactaggagaccacatgacaaatggtgtcaccaaaaagagaaaataagatagcatgaccatgtgtgccagtttgcctgagacggtccctactaaagagagtccctccgtgcctcttataaattttggtggctgccagcatcccgatttctccctccatcttcacatcaccatcgctctgtgtatgcctccttctcttcttcacaaaaaatcatattcaaaagtcctctgttgggaattccctggcagtccagtggttaagaccctgctctctcactgccaagcgcccaggttccatccctggtctgggaactaagattccacaaaccacgctgctctgtcaacaaaatattaaaaattctcccttgacttcccatccttctctagctgttgcctcccttccccacttccctttctaacaaagcctgttaaaagcactgcccacacctcccgttccctcccattttctcttgaacctactccaggtgggctctagtgcacacagcctcccggaagtggctgctgtcagaccaccatgcggttggaaacagtctcggcagatataacgaaattcaggacaagatcatcctggtttatgcaggagggacccacacccagtgacaaatgtcctgatgagagacacacagaaaaggggacacggagagaagggaggccacgtggagatgaaggcagggactggagtgatgcggccaccagccaaggaccacgaggagcccctggagactggaggagcagccaggagcctctcctggagcctccagagggcacagccctcccaacacctgggtgtctgacttccagggttcagagactaaattctgttgttttaagccgctgagtttgtggaacttgttacaacagctacaggaaatgaatgcacactccaaaggcaaagtccttcccaggcgcctgcagggctgttagtaaccagccactgccctctcgcagtctgactcccccaccctgacctcctgctcttcttccccagggcctttgcactcaccctgcctctccctggagccctcctgctccctcagcttcgtggcttgttcacttccttctggtttgttctcacacgctgccttattagaggggacttctctgacctttcttataaatagcaccccgtgttctctccctccctcgttactctgtttcatttgtccccacagcgtttatcacaaggtgtcctgtggtgggttacttagaacctaagttccaggcgggcaggctgttttctgctttgttcactccctagaacagcactcagcacagggtaaaccctcgaattttttcaaaaatccttatctgatcaaggactaacctaagaaatatataaggagctcttaaaactcagcaatgagaaaacaagtttattttgccaactaaaagtagggaaaaatatctgaacagacacctcactaaagaagagatggcaaattcaagaaatatttattgaacgaataaatgaaaggaatttcataaactaggacatttgcttatttctcaagagattgtctggtcctttttaaaaaaagtagcctttgtgcatttgtgtgtgtgtggggggggtggtttgtaagcctctcagttgttctatttgtgaccccatggactgtagcccaccgggctcctctgcccatgggattcttgaggcaagaatactggagtgggttgccattcccttctccaggagatcttcctgacccaaggatcgaacccaggtctcctgcacagcagtcagcttctttaccatccaagccacctgggaagcccaaagtagtctttatttacctgtattttttcctttttaagtagattttattttttagaaccatatagatccacaacaaaatggaatggaaaatatagagaggccccgtaactccctgttcccccacctgccatgcaggcctttcccagaactgagaccccacaccagagtggcacgtttgttacagcagccacactgacatgttactactaccaaagtccacagtttacatcaaggttcactctttgtgttgtatagtctatagggtttgggcaaatgtataacaatgtatatctattaaggtgggggtgggggttacctgccagggccagaatatctggagaatcctcaggtaacaagggctccatttcccaggcactctgacatcagggccctctgcaatcacttagcactcccaacctcatttagctcctgtcaccacactctgtagttgtacgactgcgatctccactttccagaggaggcacagaggggtcaatcaagccacccagggtcacacagcaactgagtggccgagatgggatttgaccccaggtcagcagaaaccagcacccaccctgcagagtttgtcaccagctggctgctattcaagcttacgcacgcagacctgcaaagtggaaacaacacctaacaccctggccacttggcaacatgatgttaaggactgagggagctaagacacacacgcacgcacacagcctcacagacacacatgcacgcagactcacagacacgcacgcacgcagactcacagacacacacgcatgcagactcgcagactctcagacaaggcacgcacacagactcacagacacgcatgcacgcagactcacagacacgcacgcagactcacagacacgcacgcacgcagactcacagacacacacgcacacagactcacagacacacatgcacacagcctcacagacatgcatgcacacagacacacagacacgcacgcacacagcctcacagactcacagacaggcacgcacgcagactcacagacacgcatgcacgcagactcacagacgcgcacgcacgcagattcacagacgcgcatgcacacagactcacagacgcgcatgcacacagactcacaggcacgcacgcacatgcatgcatgcatacatatagatacacacacacaccgttctctttgtccttcaacagctaatgattctgacaggaggaacaactgagccagtgaagatccgagaggttgaaagcccagtttttgcagctctagggccgggtagcctttgtgtgtgtgttggggggggcggtgtcagggacccagtgctctgtccctgagttgatggggctggaatttgaaggcgctgatggatcctcctggccccacctacacaccttgcgtaagatccagacacactttcatgatggaatcaagataaatggctgaagctgaaataaatgatgcttgtttgtgaaaggactttaaacagacctcctgagcaggaagagtcacaagaggatgagaaggcagcggcacccgagtgaggtcactagactgtaccctcccagaagccaagttggtcagccagccagggcagcctcacaggtccccaaaccccacctccctaagcaccgcattctccttcctcactttctggggtcacgttcctgggagcatggaatatgtcaacctgacatgtcatggttcagccatccaagcttagaaagggccattatttttagactgaaaaggtgtattttatattcacacacttgactttcaagaccctgaatgaattttgctgaaataaatattctcctttgggtccagtccaagtatgtgaagtttatagccccaatggccttttctttttctttcttgctttgaaaaggaatattaaaagtagctgaaaagagggatttagaaatgaaaggcaattttcaacatgtcttataaaatgaaaaggagcaaacgctataatatttcttcaggacatggactgaagtaaaacgagatttagaacccagtggtcgttccttgcgatgtgaaatgtctatcttttcaggactcaggattcggcacggcctggtcagaaggaaggtggaaattagggggaccaccgatgtgtgtccacccatgggggattggccaggacagtaatcctggttttagcactgagactcctgaattgcagaaaatcccttggtctccagcaaagcaggatgaggggtcaccctcgttgaaatcactatgaaaggagctcacaaaaccccactgacgggagtatctcaccagccctgtaggcagggtcagtgtgggctttcagacaggcttataggagggtgtgggatttttggaggcgtggaatggagctgtcttcacctgctcagctccctgccctcagcctgtccctgaggaccgaccctggtcatcagccaaggccatctacagcccgccaccctccccatccccagggctgtccgcgttgtctaagaagatagattccaaatccccacctgaaagccactgagttctcagggaggggggcacccagggatctgcattcttatctcaagctcccctgggttgctttctcttttttcagctgtgccatggggcaagtgggatctcagttccctgaccagggatcaaactcaggcctcggcagtgagggcagagtcttaaccgctggaccgccagggaattccctcccttgggtttctgacgggcaggcagctagaggcccggcctggcctctgcctgggcttccctagccccgtcatctacctgcctgtatcctgcagcccagattcccccgcatttgggttttttgtttgcctctacacagaatccttcttctgtgccccaacccacctgctctgggctctcttccagcctctccatcctgtcctctgccccagcgtcttgtcaaccatcctgacttcctacagggctgggaccctaacagcagatcacatactttcaggctgtttggggggccataggtggcacacagcatggactcaggagcccggtggtccacacttaagtatgtgagggccctcccggggagggaccgaggggaggtgggacgagacaggtgggtcaggacccagccagcccctccaccccacaccgccacatcggcaccagaccctgaagtctggggattccaagtttaaacctggtcttcagggttgttataaaggtatgtttgtcaaggtaggcaagagcatgtcttttacataattttttattttgggcctgatgtctataagattttaacacttggctgtgtggtatgtaacactcatttcttctctccaaacctacaaacgtgacaggcagacctatagttctttggtcttttttttttctggccttgcaacgagcttgcaggatcttagttctccaagcaaggatccaactcagacccccagcaatggaagcatggagtcctaaccactggatcaccagggaatccccagacctgtagatgtctatgcatacacagaagaaaaatagagttttatgtggaatccttttcttttacgtaatgatataatctacacattattctccaatttgcccttttcactgaataacatgacttcaataatttttcatgttggtgcatacagatctacctcattgaaaaaacaaccaatcaatcctaaaggaagtaaactgaatattcattggaaggaccgatgctgaagctgaagctcatactttggccacttgatgcgaagagctaactcattggaagagaccctgatgctgggaaagattgaaggtgaaaggagaagagggtggcagaggatcagatggttggatggcaccaccaactcaatggacataagtttgagcaaactccaggagaaggtgaaggacagggaagcctggtgtgttgcagtccatggggtccaaagagtcgaacacaactgagtgactcaacaacaacgacgatgtgcctgtattccaattttttaggacagctgaaattcttcccaagacgtcttccttaagaaaagaagttttccatgtgcctgagctaagtgatgtaggcgagtctgattgaacagaaaccttggtggcagccagcatggccagcccgtggatacgcccctctgctgacagcacacgcctcaccctcccagggtccggagactttacaatcagaggtcacgttctaaggaaggaagttcaggctctcagaactgggaggcaactcactgggtttgcaaattcttcatcgattcgtaacatattctcttgctgtttctttgtcagtgggtcaggaacattctgctttcttctccttaagggagttcatgtcgtgatcgacacttgcctctaattgctgctccctcccttccttggaaactaatcgagcattttccaggtcaggttgctgtttagtcatctgaacacgagtccccttcctcttgccgtaatctttcccaggctggattttgtctttgaaacaataggaaatgacaaggtctatttttcttttcttgaaagaactcgatccacggagtcatgagttggaacagagaaagtccggggaattaatatgcacccccgatcggaagtgaccagctttcctgtctttgttctgccgagtcctggagtctgagctcatgataccccaggcagtgtgcttacaagcaggaaggctgcattttcacctccagataaatccccatctgggttttctgttggacccattggaaagaaatgcaattaggccctgagcagtcttcaagcaaagactggaaaccttccaaagaaaggctgtgccagatatccttcggtcctcgacatacatttgcatcattggagaagttcactgtgtcttaaagcaccctcgagagtcaggccctggaagagctttctattaaaagctatttaatttctccaacagaaaattcagttgtaatttggtaatatctaagccactgagactaactgggggcttccctggtggctcagtggtaaagaatccacctgtcaatgcgagagacgcggattcgatccctgatcggggaagatcctacatgctggacagccgttaagcccaagtgccacaactatcgagcctgagcccatgagtcatagagcttatcctccagaataagagaagccaccccaacaggaagcccacgcaccacaactggaggatcgctcccactcgccgcaactagagaaaagtccttgaagcaaagaagacccagcacggccagtaaataaataataaaagaaagaaagaaagaaaattatatttaaaaaaggctagctggatagtgatcggcaaccttaaaatgaggagaaattactattccaagagctcgaggcctacgtggttggaggccaggcccagctgattactggctgtgagtgggttgaaagcctgatctcagggcttccctgatggttcagtggtaaagaatcctcctgccggcgcaggagacacgggttcgattcctgggttgggaagatccccctggggaaggaaatggcaacccactccagtattcttgcctgggaaatcccatggacagaggagcctggcgagctacagtccatggggtcagacatgacttagtgactaaataacgaacctgctctcaacactgacgtttgcttctgagggatggaaggatgctggcacaagtgggtgatgccgtctctacagccaatcctgttgtctggagtccagcgcctgaggttctgtaccctgttagcctgaggcctcactgctccccattcccaaacatgtgcctcctgttcccacctcctggcccactgctgcggcttcccccgccccccgctcatgttcccgtacgaccacctttgacaactctgctcattcctgagggccccgttgagcaccacctcccatcagcctctccagcccatcaggtagaaccatctttctgggttcccagggccatctttctgagcatgtaacaccattcctacactctgggttgtgaagctgaaatccccaaaggataaagagaaggcctgtgcagactctgctcccagattcggccgagagatggaagatcctgaaagtgaacaggaagaggaaggcgggaggggtgggcctggtgggtcagctgctgttgcctggcggggtagggggacagggccttgaggtgaggaaggcttggcctgaggtctctctctggaccttcctgggggtggaggggtgctgctagccgttgggtcaggaagaatgcgggggctggctcatctcagaagctctgtgcttctcaggaggcaaaagaaggggaatgtacagcagctgctgctgcaggacaggtggccggggcaaaaggcccccatgggctgttcccccctctctggggcaggaaaggcagacccgacggctggggctgcggttctgcagggatcgggacgcacaaagactggatggcaccaagggccgccataggacagagcccacagggcttggggactaggggcacgtcagggtgtccccagaaaggtgagcccagtgggagtaggtgcgactttgtcccatgtttctgtgcccagatttatttttatttatttattgagtcagcaaatattatatatatatattttttaaacttttaattttgtattgggatatagctgatgaacaatgtcatgatagtttcaggggaacagcgaagagactcagccacgcgtacacattctgcacctgtgatgttgatccgatgacaccctcggttggtaatgaaatacccgctccatttcattgcagtgagctgggcctggctctccctgtctgaccgaacactctggctcagcatcgcccagcagagctccctgcaccatccaagacaggagccactggtcacgtggccactgagtcactagtgtgactgaggaactgacttttaaatgctattaactgctttcggtttaagattagctaggcacatgtggctgctggctctgtgttggacgatcagcattgtgtttagacaccggctcattcattctcaagggagcctagcgctgcccccgcagggaggtgcctgttgacttgaaattcctacaaagaatgtgatggccttggatgattattagctggcttcctgcattttcccttatctggctgatattatcgtgcctctttcttgccttatttccagctatagaccagtatggcttccagtcgacagggcatttagctggagtgtttatttaggatttaatctctgaggctatgggccagtcatgggatggagtttggccaactctgcactggtggtcaggcttacaatgggcttcttaaaaccaagctgaccacagttccgggtttatgactatcctgccaacactgggcccggcttttcaggtccaacttcacaatggagttggctgaagaatccaaagaaggtcaggccttgacactttcctgggagctctgcggatagtcattcctcctccaaactcctctctgtggcagggctggaggctgccttgtcctcttcagcagcttgttctcattttgcccttgagttctgtccaatcctctgaggacagtgtaactgatgacgttttggccatgctggatgctgaaactcaggaggaagaaataattgatgaaattgatgaaattgatgagtttgatggaattgatgaaaagaaaagctttcatttatggtggtttttcttttttaaatgcagggttttttttttaaattatttccttttggctgtgctgaggcttcattggttcacgggcttttctccagttgcagcgagtgagggctactctccagctacagctcacgggcttctcattgaaatggcttcgcttattgcagagcatgggctctaggtgttcgagcttcagcagctgcattttgagggctcaacagctatggcacaccgacttaagcttctgagcatgtgaaattttcccagaccagggatcaaacccatgtcccctgtgttggcaagtggactcctattcactgtaccaccagggaagtccagtttcccaagatttctgaacgagtggcttattgaagcagtgctcttaggagaaatacttccaagaaaattgctgtggtctgagtgtttgtgcccctccaaattcacgttcacatcctaagccccagaggtaaggcctccgggagattttgtttttgtttagtttttgccacaccacatggcaagtgggattttagttccctgacaaagaatcgaacccacgccctctgcattggaagcttggaatctcaaccactagaccaccagggaaatccctctagagctttctagatcaaaaacgtggagccctcatgaatgagattagtgcccttatagtagaaaccctacaaagttccctgtgtcccttccatcgtgtgagaacacagcgggaagtctgcaacccagaagagggccctccccataccatgctgacaccttgagcttggacttccagcccccagactgtgaggaggaaatttctaaattttataggctacctagtctgtgggattttgttacagcagcccaagcaggctaagacagaaatgtgctcactcagtcatgtcactttgcaactcaatggactgtagcctgccaggctcctttgtccatgggattctttaggcaagaatactacagtgggttgccatttcctcctccaggggatcttcccaacccagggactgaaccagggtctcctgcatcgcaggcagattctttaccatctgagccactggggaagccctaagacagaattcagttcagttcagttcagtcgctcagtcgtgtccgactctttacaaccccatgaatcacagcacgccaggcctccctgtccatcaccaactctgggagttcactcagactcacgtccatcaagtcagtgatgccatccagccatctcatcctctgtcgtccccttctcctcctgcccgcaatctctcccagcatcagagtcttttccaatgagtcaactcttcgcatgaggtggccaaagtactggagtttcagctttagcatcattccttccaaagaaatcccagggctgatctccttcagaatggactggttggatctccttgtagtccaagggactctcaagagtcttctccaacaccacagttcaaaagcatcaattcttcagcgctcagctttcttcacagtccaactctcacatccacacatgaccactggaaaaaacatagccttgactagacgaacctttgacagaattggtgaggggcaattctctgcacaagaggacagctctgggccactcacagccgcccttgcagcagctggggtggtaccaggcttggtgcagggttctgggtgggcacagcatcatgcctggcccatttgtggggttggcagtgggaccactcacagggcctatggagaattgcttggtccctggctgtgtgtgggcttccctggtggctcaaagggtaaagcatctgcctgcaatatgggagacctgggttcaatccccgggttgggaagatcccctagagaaagaaatggcaatccactccagtactcttgcctggaaaacgccatggacggaggagactggtaggctacagtccctgggatcgcaaagagttacacacaactgagcaacatcacttcttctggctgtgcactcctccgtgaagcagcaagtgccccaacattgacagagcaagacgggcccagctaacaagctctgtgaacccagaaggactgaattttacagcaggaggctcacattttcaaagtcagtgttttgcagcaagtaactgaggcagtgatatgggcaaacttcccaccgagctggcctcttttcacaggacttctgggaccccaccgcctggagaccgtggggcggcagtggccccgacttgcacaaagcttagaagcagtagtctatgagtgccctgcactctctgggcggaattccacctgggagcttccaccagccaccacactccattggcaacccctgattcaaagttgcgttggtctgggcttggtgcccatccaaacattctcagcaggactcctcagcctccttccttgagaagaccatggcattcttctcgtgggctcggaaaatgcaaatgaacaacttactgcatttttgcaagccaaagactgctcttcgccttggctggcctgtttcccagctgcctctctgggggtcctgggaggatgtgcatgcgtgtggaggttggggggagacacaggtaagagaagaaccattgtggcattcaacaagagctttgagactgaggtcagtgtgggcgcagctctttctctggctgaaaaagtaaaaaccttcagctggcatgttctctttaggctcacagagccatcagatgaaggtagttatattcacggagccagagaagatgctgcttgggaattaggactagagaccgtggtgggaggctgttctgggagccgagacagcactgaagtgcctcttgctgagctcaggaaataaaaggacaagggttctctttgattagaacaaaattctcatgaagaatttaaacaatggagccatatgttcattctctgctatgacctggaagagatttatctctaatgacagattgaaagcgagtcatcccgccctgtcaacttctcccaatcccctatgttatagatggacgactcgggtccctggaggtgctgaggggtttcagcctctgcctacaccaccctagcctgtgcatctgacacctctgtggaccgagtcctaccctcccaccttctcaggtaagtgtaagagacgcacattctgaaattgacagaagcaagagtgtcactctgactcaccttcagtccctgttcctttagttgaatggaatccacctaatgcctagtcaactgtatctgcaattgtgtttttacatgtagtctcttttctttttctggctgcactgtgagcagtatatgaaatcttagttcccgattagggattgaacttgcaccccttgcactgaaggcgttggacttttaatcactggactgctggggaagtccctgcgtagttccactgctattacaatgctacacatgaatgtttacagcagcactactcacaggagcccagcgcggaagcaacccagatgtctacaaatggatgaattaatgaactcagcgtggcctctccatatgtgacagtgttagttgctcagtcatgtcctgctctttgcaaccccatggaatgtagcctgccaggctcctctgtccatggaattctccaggaaagaatactggagtgggtagccattctcttctccaggggatcttcccaactcagggattgaaccaggtctcctgcattgcagattcctcgtctgaggcacgaggaaagcctggtttatacatgtagtgaaatattattcagccgtaaaaaggaagtactgattcatgccatagcacaaatgaacttgaggacattatgctaaatgaagaaagccagtgaccaaagattccatttacatgtgtgattccctttatatgaactacccagaataactaaatgcacagacacagactggtagttgccaggggctggagaaaggaggggatggggagtggctgcttactggggcaggagttttactttctggtattgaaagtgttttggaattaggtagaagaggcttccctgatggctcagatggtaaagagtctgtctcaatgtgggcaacttggttttgatcctgggtcaggaagatcctttggagaaggaagtggcaacccactccagaattcttgcctggaaaatcccatgggaggagcctggcaggctacagtccatggtgggagcaaagagttgtacacgactgagcgacttcacttcagaattaggtagaagtggtggtcctaccacactgtgaatatattaaaagccactgaactgcgtgccttaaagtggttaattttacttcacatgaatttcaactttggtgtagactaaaagtttgtgtaccttaaaattcatgttaaaacctaacacctaatgtgatggtatttggaggtgggacctttgagaagtgattaggtcatgatggcagagccctcatggataagactagcacccttataaaggagacctccagcttcctgggtggctcagtggtaaagaatctgcatgccaatgcaggagacgcaggatcaatctgtgggacaggaagattgcctgaagaaggaaatggcaactcactctagtatttttgcctggaaaaatcccatggacaggagcctggctggctacagtccatggggtcatgaagagttggacatgactgagcaactgagcaggaaccaaaggagacctcagagaattcccagccccctctgccatgtgggcacccagcaagaagacggccagctatgagccaggaagccaggctctcaccagacactgaatttgctggccccctgatcttggactttcagcctccaaaacagaaataaatttctgttgtttataagccattcagtctatggtatttttgtaatagcagctagaatgaactaaggcaaactgaataacaaaaaacaaagcaaagcaaaatgcagccgctcccccatacgggcagctaggctggttgatgagagacgggcccttcccccaacacccacctcctctgtgtaactcagaggggccttcccccctcaggatctggggactgagggaaatgccttccatcctctctgctgatacctgggatactgagggaacagctaggatttcctcctcaccttacccctgagtcagctccagcactttgtaccatgtgacttggccccactacttaacctgtcaaccttcagcctcctcaacgatttatacctgcttgcggggttgatgtgatgatgaagtacgataaggagggagacctcgttggtagtcagcatatgagaagatttgacaccatcatttttatgctctaagtacctctgggacaagaaagaaaaaaaattcttttcttgttctcagttcaattcagttcacttcagtcactcagtcatgtccgattctttgcgactccgtgaaccgcagcatgccaggcctccctgtccatcaccaactcctggaatttattcaaactcatgtccactgagtcggtgataccatccaaccatctcatcctctgccgtccccttctcctcttgccttcaatctttcccagcatcagggtcttttccaaggagtcagttctttgcatcaggtggccaaagtattggagtttcagcttcagcatcagtccttccaatgaatattcaggattgatttcctttaggatgtactggttggatctccttgcagtccaagggactttcaagtcttctccaacaccacagttcaaaagcatcaattcttcagcactcagctttctttatggtccaactctcacatccatacatgactactggaaaaaccatagatttgactaaatgggcttttgttggcaaagtaacatctctgctttttaatatgctgtctaagctggtcatagcttttcttccaaggagtaagcattttttaatttcatggctgcaatcaccatctgcagtgatcttgaagcccccaaaaataaagtcagtcactgtttccccatctatttgccatgaagtgatgggaccagatgccatgatcttagttttctgaatgttgaattttaagccaattttttcactctcctctttcactttcatcaagaggctcttttgttcttctttgctttctgccataagggtggtgtcatctgcatatctgaggttattgatatttctcccggcagttttgattccagcttgtgcttcattcattagtcactcagtcttgtccgactctttgtgacttgatggattgtagcccgccaggctcctctgtccatggaattctccaggccagaatactggagtgggtagcctttctcttcttcaggggatcttcccaacccagggatcaaaactgggtttcctgcattgcaggcagattctttaccatttgagccacgaatgaagccccattgtaaaccactgttgttttagtcactaaactgtgcccaactcttttgtgaccgctcccccccgcccatggattgtctcctgcattggcagacagattctttaccactgagccatgtaaaccataatttatttataaaatcaagaccaaatccagtctactgcctgtttttgtacagtccatgagctaagaatggcttttacattttaaaataattgattaagaatatatgacatgtgaaacttcattaatttcaaatttcagtttccacaaataaagttttattgaaacacagctgtgttcatccattatgtattagctgtggttgcttttgagctccagtggcagaggtgagtagtgggggtagacactatctgaagagaaatgcctaaaatatttattatcttcacttaaaatttttttttgccaaccctgtctctaaacataataccaccagtgagcctgaggtcactcaactcatgcttgccatcttgaatattagtataatttcttgatggatagacagagatcttctacacatccatctgtaaaatgagaatgatagcatcatcgcatgaagttgtcatgagtattaaataacttagtgcatgaaaagcagctagaacagtgctgggcattataagtgctcgataaatgtgaactctagttctgttagcatatacacatgaatttagataaataatagaagaccaagacttcttccctccaaatttattttgggatgtgctgtaaacagtttgaaatgtccctttaagaactttctggcttccccagtactggatggcatgacaaattctccttcacagaaggtacaagcggaacagagctggaggggctttgggaaccttccctcttcagaaagtgtgctcacaccaggatgtatctggctctcagtagaactggcccatgtttctcgggagtgaagtgtccaagccactgttcatccatatttcctggatgatctgctccctgcgctcaatcctttctgccaactctgcagcctctatggaactgtagacgggatatgtagtcctgcaaaacccagacagttcccctgggaagtcggagtcagaggagtcctcctccccctcctcatcctggctgtcctcctcggccttgtcacttcctggcacaaggtgctccctcgccagctgcagctcctggaagtccttggtgcaggacactctgatgaccaaagcacacaacgtgagtgccagaccaacgcagacactggacacgaacagcagggcggctctctcgggatgggctgcaaaggcaagagaccgcatcaggacccagaggagccgccagtcctcagcaggcccaagtcccacagaagtgcttacgtgccccagaggagccgccagtcctcagcaggcccaagtcccacagaagtggttacgtgccccagaggagccgccagtcctcagcaggcccaagtcccacagaagtggttacgtgccccagaggagccgccggtcctcagcaggcccaagtcccacagaagtggttacgtgcccaggcaggagggtaacgcagaatcccaatcctggacagaatctctgcgaccatccacacctaagagcatataccccgactaattaaaacaaacaaaaagcagtttggagcatgtatagtcaatatatgtatgtttatgagagggcacataccaaaggacctgagaagctgaaccttcctgagttcatatgcagacctgccactcactagttgtgtgacttctgacaaattacatcacctctctctgcctcagtttttttcacctgtaaaatggagcccaaagcccctttctatcataaagttgagttactttctatgatgctctcagaacactcaatgacacataacaaatgtttaagaagctgtcagctattattcattgtagtaaactttgaaaaatgaattacatataaagtatgagtgtaagtcctaagatattaaatgttacacagcttaatttctttcagattaaaaaataaacacaaataaaggttctggtaatgaaagttcaacatccaaatgattgtataataggaatagaagtaatgctaatttgtactatgtaccctggtctaaatcctaatatacgtttaatccttacactagccctatgtggaaaggactattcctcttcagctctgtatccctggaggtactagcattcccatttggggaagtaacaatccagttaactttcctataatatagatcaggagctgatagattttttttcctataaggggtcagataggacctattttaggcttcgtgggcctcaggatctgtgtggcaacttctcagctgtgctgttgtaacatgaaagatgatacagatatggctgtgttctaataaaactttatttacaaaaccagcctgtgggctgtactttgtgaatccccaacatagagactcagactgagggtggcatggggagccaccgtctgagcttggttggcttctttaggtggagccaggacaggaacccagctcctgagctgtgagcagcttgtgagatgaacatctacaaccactgtcacgtgctcctacgtctccacagaaccatcctcctccaggcacacagccccctgttcactccacttgaataatgactgttggctctgctgccttggtccttccaagggacacagactggaggttcagatctcaacggctgttacgtttcatgtccagtcaagaaacccaggccctgtgatctgacgggagagctctaagtgggacacgttatcttcgtgaaacgtgaaacttccccggttggcttccttcactcgcagttcaagtcactggtgaagtcaccagcctcaaatgttctttgttgccaccagccctctgagcacagtctcatcactctccctaagtcacagaagtctgaacgcgaagctgattttggcggggagaggggcagtgagctgtgtctgcaatgcagacaatatattataacattaaaactagtaaattttaaataaaaatattaaaacattataaaaataacaacaacatatttttcccaagagttaaggttattttgattctggaagtgttgttagtcactcagtcctaactctttgcaaccccgtggactgcagcccaccaggctcctctgtccatggaattctccaggtaagaatactggagtgggatgctattcccttctccggggtatgttcccatcccagggatggaacccacatctcttgcactgcaggcaggttctttactgtctgagccaccagggaagcgccaagatagtttgaagatttggtcgactggaggcacatcttttgtgttctatttctgcgagtggtggtagaactgggattgggagatgctggcatttgggacacagctgtgaagccattaagccagaatattacagaaaatgatgctaagacccaaggccctgatctgagggggcaaatcctttctccttctccccttgcatgtcaaagcctctgctgggagtggactcattgcttctgactccactgccaccttcctttccctcaaatcctcctcctttcttgtccctgctgccccctgccccccacctccccgccactgccccaccaaacctctggatcattgtcttctccaatccctcctgtcctcatggttctgatatgggctttcggtgcagccataattcagcttcccctcctcctgtgaaagcgtcaactttgagcccaccaacagccaggccaacaacatcacctcctgccatgcctgcaaggactgctgccgatggccaaacggactcccacccgtttgtgaccttttccagccagccccattcaggacaggccagttccaggcagaaataccccaagctggtcaagcttctgggaaacagtgatcacccacagcccccttctctccttgcccacaagaccataatttccagcaagggtttcatgggcgaagaaggagctcaggccaggacagaggcctgcctctgctccagacaggtgggctagttactgtttccccttccttcctctctctctccttccccaaccctatttcttttttaaagaattaaactaaccatgttgttgtttagtagctaaattgtgtctgactagtctcgatcctatgaactgtagcccttcaggctcctatgtccaggggattcttcaggcaagaatactggagtgggttgccagttccttctccaggggatcttcccgacccagggatcaaacccacacctcctgcttggtaggcaggttctttaccacagagccaccagggaagccttaggatatgacacattctctttatgggtcaatatatggccttcctttgtattaattcattcaattaagcaatttaaattctgttaccagcacctgtgctgtgaataagccccctgagtgggagctggaccttaacaatacctgtgtctaacctgtgggttccccccccaccagcctcccctcacatcaaggtaactaccacctacattccatggtcattcctcccctgcttgcctttttaatacagcattctgcatctccatgtattcctaacagctttatgaaaagggtgtaacattacagcttagtgtctgggctttggcgtttgctttgaacccaacagtatatggctgcatgctactccgctgtcttgaaggcaccggttcgttcacgcagtcgccaggcggcgggcatccgggggctgccaggttccttctgtgggccttagagccgcgaccactcctgcaaatgtccctgggtcaacacgtgcaagtgtttctccccggtgctgacctaggagggcaactgaatgagttgtaagatgtgtgactttggggaaatgtggccagggtggcttccggagcggctgcagtgcctgagaaatcgcgtgactcctcgtcttctccagcactaggtatggacaggattctagctttttcccaatcatatgggtacaaaactgtatctcgctgtggcttgacttgtatttatttccccggcccccaattatgtatccatctcttcagatgcttacctagtctctcttgtcaaaatgctggctcatgtcacatgcccacttttaaaactgggtctgcgctaggtatatctatgtatacatacaggttccatatattgttgatattaggcattagacaccatatagatggtgaatgacctgtattttcctatcattaaggtgtctttggatctagtgaacttatctgaaaaacaggaaggataacacttctccacctttcccgcacccagctgctctcctctctcctttcctgccctcctcattcattttccccattggaactgtaatcttttaaaaaatgcacatcagatcgcatccttgtcctacttaaaacctataaccctctctctccgcctataagataaaaagcaaaccctgatcacacctatgaagcttgctagaacctggccggtgcaaccagcctcctcaagttcaactccaaagcttgagcccctgctttctgctttgcggccactggcctctctccgccctcacaggagccagatgacgtggcaccttggtgcttctgcacacgccgttccttctgcctggaatgttccttctccccctcctcatccaggcctctgtgccccatgcccagcctggactcagtccccctgtcattagatctcatagcctctcgaatgtcgctaagtctctgagtgtattttatcctttctcaccgcaaagaatgcaagctccctgagctctggggctgaacggccttgttcttcgcccagtccccagtgcccagtcctaagtaagggtgacacagctttctgctgagtgctggaagggagtggccgtggatctacagcactaggcttggtggcctagggtcgtgggctccatgatgttagctgcctttcttcctctctccctctgctctggggggtaggggtgggtgggactggggatctggattctggtgccaccagagcttctcactcatcagaccctaggcacctctggctcccaagaacctcctgccaagtgatcactcttcaggccattaaaccaagtctgctgagatccaatgatcaaagatggaaaacgtggcaactcttgggccagccaactggaatcgaggtttcctagtcaactgagccaactggtctgcagtcacagaatcacaggtgttagctgatggagccatggctgggaactggcccagttcctccggttctcacttgtccaaagccaccacccagctgggacccaacctcgggtcagagctctctccagagccccaggctttacactaagaggacgccgtctgttttctaaaatcaactggaccactgtaggcttttgtgacccctttgcctatcatgagtgtgcatgctaagttgcttcagttgtgtctgactctttgtgacccaatgggccgtaggctcctctgtccacgggatgctccaggagagaatacccatggggtgggttgccatgccctcctccaggagaccttcccaaccctggctcctgggagatctaagaacccacatctcttaaatctcctgcattgagagctgggttctttaccactagcgctaccagggaaaccctttgggaggtaacagctaggaaggccggggtctccaaatggaggaaatgggctgcaagtgtcagacatgtttatctctcttaagcggcaggaggaaacaaactagtgagatatatatatacacacacacacacacacatatatacacgtatatttttccccccttctctatacaaattttaaaaggaggtttctcttaaaatactgtgttgccataatgacacctggttccacctgaagttaactattctcaaaccttgagttaaccaatgcctttttcttatggaatgtttgtcttaagctatgctaatgtgctatgcatttaccccagactctgtcttcaagtcggttcgcctaatggctcagaacctacttgacaaaccagtatgttatactcagacattgttctcctaatctatgtaaatgaaactatttgtatgataatctcccttctacaagattcaagtcattcattttatggcccgggatgagtcgtctggtgccaagattatcccaaaatatatcttatggatgaggggcctggtgccattctgagttttaagccattcctttttttcataaacagactgctagtgactatataacatccagctaaaaactagcaggggggtactctttctgcccccttctgatgcctatgtcagaagctttctttatctcctttatactttaataaaactttatcatacaaaagctctgagcaatcaagcctcgtctctggccccggattgaattcttctcctccagagaccaagaatcccggtgtctttttgtgggtcagcaatgacctttcacctttcctattatatattctgttaaaataaaggcattagactccctgttaaacagaatcctcacactgtgctattgtcagtcttactctcatttggccttagttcctcgcaggtccagtgaatgacttgaatttcatcagtggtagcaagccctggggagtctcaccaaggtggcctgtggcctttaaggtcccttgactcttagaactctggtctgaagccaacacagctccagctcaaacgtactgtatctaaaaaagacaccaagagactgggcaagagttccatcctgaggggccctgctaccatcaggtgaaaaaacaaggcctgctgggcctgatctgacagcacttagggatgtgatagtaactttctgtcatggaagcaaagattagagcccgtgggaacacttcagaacccacacctccgtgacaaggcggtgctgatttcccatccttctccctgacaggggatcatgtaactccaactttggaatgtgttatgatacttctgtttcattgtgggtctgtctgataccctagagctcctttcacatgaaacaatgacgccctcccaatgcaggagaaatgctgcattctcatccatgaccccagttacccccacgcaccccgaaagtccacagtgagctctgcagaggccgaggacacacacaggcccgagcccaaggcaggaccagaaatactaggctgcaaagggcaggaaatattaataaaatgctcactagatggaatggaagacatcaagttctgagcaagactaaataaatatcctttgacacaatcttcagctgagccagctaacaaagtcacttccccaaatctccaacacacacacacacattcatacacacacagactcacacacatatactcacagagagagagagagacacacatccatccctttccatttccctaacttcaaaaattttctaagagcttcttcagacccatgatctaaattctagaatgaattcaataaatatgtctatattattgagaagagggtaaattcaaacgtgggcttccccaggggcaccgtggtaaagaatctgcctgccagtgcaggagacacaggagacgtgggtttgatccttgggtcaggaagagcccctggagaagggaatggcaacccactccagtattcttgcctggcaaattccacagacagaagaacctagtgtagtctgtggggtcacagagagttggacatgactgagcgattgagcacacacaaattcaaacactcctatgaagatgtctcacagaccatttaaatggctcaaagagaaatcgttcatcgggaacccttggatatttctgtgtccattccaccagcctctgcgtctccacgtcccgggataagccccttgactctgggttctagtctgtcggtctcccacgtgcactcggaggcactagtgtggccaagctatccgtagcctgacctgaggacgtgtccttttgatttgctcagtccatcgtctattcggtgattttgccagaatcctcccagctcactcttggtagcttctgttgggacctctccagtaggagggcctcctcctctcagtgggtgtccagggagcccagaccagccttctgatcacatccctacatggaggatgaagatgccactgagagctggctgaggcaccactttctagtgatgctgatggtgatactctcatcatgagatgctcgtgttgaaacggctcagcctaaggtcctgcccttcactgcaatgtgctggcctaaccagtgaggaggatgctgtgagctggggaccattcagaagaaccacccagagagtaacatgcccaggaaattcacaggcaggggcccctgtccccctaaggtttttgtgagcctctgtgatttgatgaatgaacttctagtggcagctccatttcattaacacctgacacagcacattcagagtctctttctctttaacatgaaattttggcttggccttagaacgtgcctaagcatcccttgataaaacccaataatccaccgagtctgtacattccttaaaaattggatacttacaaatagcaaataccagtgttgataaggtacaggatagctcatgagaccagaggaggactcaccatctggtcattaattaactgttaactgtgcatctactcggtgccagctctgtctcaatcactaggatatggcaatgatgaggatgacaaacatctgcagttgaaaccttaatgtctagtgaaaagatgggtgcctaataagtaaatctctccaatgacttctgatgctgatgctgaagctgaagctgaagctccgatactctggccacctgatgcaaagagctgactcattggaaaagaccctgatacttcgaaagatcgagggcaaaaggagaagggggcagcagaggatgagatggttagataacatcactgactcaatggacatgagtttgagcaaactccaggagatggcgaaggacagggaagcctggtgtactgcagtccatggggtcgcaaagagttggacacgactgagcaactgaacaacagcaaaaatgactccttggagtaataagtgtgcaagaggagagatagggatggagagaagctaattcagacctctcaaggatattaggtttccatccttcaaaattctgaagggcacatgtctctcttggagaagctggagggcaggttttgtatctgttgagtcagatcctgccctgctgctagccactcagtgtcctcaggcacatggatcaagtcctctgagtctcagcttccttgtgtgcagaagagaggatgagtccctcactgagggtcattactacttattgtaacctctgaaattcatgcactgaaaccttaacccccagtgtgactatatttggagacagaacctataaggaggtaattaagtttcaatggggtcatacgggtggggccctgatccaacaggattagtgtccttataagaagagacaccaaatggaatctaaaatatgacacaaatgaacttatctacagaacagactcacagacatagagaatgggcctgtggttgccaagggggaggggaagggtgggggagggtttgactgggagtttgggattagcaaatgcaaactattatatataggatggataaacaagatcatagtgtatagcacagggaactacattaattacactactatagcttgtgataaaccataatggaaatgaacatgaaaaagaacgagtacgtatattaatatatgtataactaaatcactttgattacagcagaaattaacacaatacattaaatcaactgtagttcagttaaaaaaaaaagaagagacatctagtgttttctttctctctttccctccctgctgtgtgaggatacggggaaggctgtctacaagccatgaagacagccctcactaggcaccaagcctgctggaaccttaatcatggccttcaagccaggaagaaaatacatttctgttgtttaagtcacccagtccacagtctcttgttaaggccgcctgagctgaacaagacagttattgaggagaatggcacagccgagagtggccacagcacacaagccttgtcaccacttctctgtgtgaagcatttccatgttgcctttccaccaaggggctctctaaggactctgaaaatatgggatatttccaacaataaaatcccttacatcgcttaagtttgacaattatcaggaacagaagtgggatggtggttagaaaggagaggattctcaacaaccacacaaccaccacacagggagaatattggtaagaaggtcccaagccggaataccagctcctggattgaggtgtttcctcaagcctttcttatcctctatggaaggcgtactccaaatagccccaggtctggcaagggctcgaataagtcatgccataatgcattctgttaccacgtatttcacaaaagtcttcggaagttttggctccctgaacagagtcaggcaggcattgccgaaacttgcagtcaacattccaaaatacggcccatccagaggttagcagagaggctgatgaggaaagacggtgtgcaccattccctcgaagaagagccattcaggctccgctaattagggaggatggagtctgattgatccttgaggggaagattatccagggaaaccctggcaaccgcaagcagtaacgctggtgactcagaaagggtctctgcctccacagaccacgacctgttttgttaagtcatctttcggctcagtgttcttccagccaagggtggaattcaataatcctgtgcccttcccaagttttcgagctggaaaatgcattcctcagcttcctactttgcaaagcggaaaattcccctggagaccagctgctggggagtgtgacttaagcttttgtggttctcttgttgatcgccagtgggaccagtacctaaattcagatctctgtgcttctggactgtagaagactgcagttgctgtgtcaaatttaaagtctgttttctataatattttatttggctgtgctgggtcttacttagttgaggcatgcgggacctttttttgttgttgttgcagcatgtgggatctagttccctgaccagggatccaacaggccccctgcactgggagtgcagagtcttagccactggaccatcagggaagttccctgctttctttagccatccaagtgttacaattaaatagagcatttgtgaataagaattcagtaaatccatctaggaagttttcaattacctacctctaatgtaagcaaatgctgccaacgagtggctgacaatcacaccatctttcctcagaaccctcggttcccttgggtcaaggtctacgcctgtttcataaaaaaaaaaaaaaaaaattgcaaggctgattaatcacaactgttcctagttttcactttgttcctaaaccaggactgccatcataaataaaaagtcacagaaatccaataagtggacaaaattagagatgactaagccagaaagcagagaaggcaatggcagcccactctggaactcttgcctggaaaatcccatggacggaggagcctggtaggctgcagtccatggggtcgctaagagtcggacacgactgagagacttcactttcacttttcactttcatgcactggagaaggaaatggcaacccactccagtgttcctgcctggagaatcccagggacgggagagcctggtgggctgccgtctatggggtcacagaattggacacgactgaaacaacttagcagcagcagcagcagcaagccagagagcattttagcagacagtctgaaaatattaagtcatgaaagggatttagaaattctaaaatgtgttggttccagcttcattcatccactgtactgcagaaaggaagacatttctttttccattctaaaggcaatggcactcatcatacctctgggagatttaataatgtcccacttaactatagaactgctgtctgctctgttgaccacagataagaaggccttgaattatggagggaggttagctggaaacgtctttggaaatgatagcaaaatgcagagcagatctggtttcagatgcctggttaggttgctgcgatggagcttagggggcccctaatggggcagcttatgggctctcgggacccctgggaatgttagatagggttttcaggcccctaatggggcagcttatgggctcttgggacccctgggaatgttagatagggttttcaggttttcagggtttccactgcaagggggccaggatattcatgggaaccttgtaggagccctgttagaaacagcagagaggatgagagaggcagaacctggtggacagttggaggggcagaactagaatattaacagtagtcatcctaggctttgagactagggaggagttctgttttcttgatattttcctgtgcgttccatatcaagcatactttacttttatacttagagggaaaagacttcataaatggaattcaagtaacacaagaccaactctcaacccacaaagtacaacatcttatacagattgtcttgggggcctctgtagtttctattaggagccccaagagtctaaattccattctagatttgattttcaagacaaacccaaaatgttcattcccttatttaccaaagcccagggaaagcctcaggcagaaaggcatgtatggatggaggtctgaaggccaagcctgggtctaacccttcaggttcccaaatgggatcgtctttccaacaagcccatcagataatcgaggaaccccagatttacttctgagcagatctcctttttcaaggtgatttttttcctttaggaaatgaaggggaacaggaggatttaccctacttatagttcaaaacaccacaggctggccaccatgagtaaccatctgccacagctctgccattctcagagctggcagctcacacacctgagggccctttgtatcctaaccatgggcatccacctgtggtcacgtggggctgttcaccttcacttaacgagaaatcctgatagtaagccataaacattaccatagtcgccatctttctgcttcacagaaggttttagattagcaactgatgggtcaattgcggtgagtatattcttgggaactgaaaaccaaaaagagatattttagatactttggacacttaaacagatctttaaaatgtcctgtagataagattaaaaagatcaattttctaatcagtacatatatcattcactctgcttgtccaacacactcacacagatacaccaatggtacccatacgatcatcaaatgtcccagaaaggtctatcttgcagtattaaaaaaaaaaaaaaaaccatggagaacaaataaagaagatatggtatatctatcccatagaacaatatttagttggctaccctggtggctcagtgggaaagaatgaaatgtaagagctgcaggttcgatccctgccttcgggaggatcccctggagaaggaaatggcaacccactccagtattctcgcctgggaaatcccatggacagaggaacctggtgggctatagtccaaggggttacaaatgagccagacaagacttagcgatatggtatatctatccaatagaatatatttagcaatagcaaggagtggcatccaatcactggggtcttcttggtttgcttccaagacccaccttggataccagaacacacaggcactcaattccctcatataaaatggcatctgatttgcatgcaacccacccaatatcctattgtatactttaaaccatctctaggttactgacaatacttaatacaatgtaaatagtcataagtgaaagtgaagtcgctcagttgtgtccgactctttgcgaccccatgaacccgaagcatgccaggcctccctgtccatcaccaactcccggagtccacccaaactcacgtccatcaagtcggtaatgccatccagccatctcatcctctgttgtccccttcttcttctcctgtccccaatccctcccaacatcagggttttttccaatgagtcaactcttcgcatgaggtggccaaagtattggagtttcagcttcagcatcagtccttccaatgaacacccaggactgatctcctttagaatggactggttggatctccttgcagtcctagggactctcaagagtcttctccaacaccacagttcaaaagcatcaattcttcagtgctcagctttcttcacagtccaactctcacatccatacatgaccactggaaaaaccatagccttgactagtcaaggctagatggacctttgttggcaaagtaatgtctctgctttttaatatgctgtctaggttggtcataactttccttccaaggagtaagcgtcttttaattttatggctgcaatcaccatctgcagtgattttggagcccctaaaaataaagtctgacactgtttccactgtttccccatctattttccatgaagtgatgggaccagatggccatgatcttagttttctgaatgttgataatagttaatacaatgtaaatagtcacaaatacaatgtaaatgtattattgtaaatagttgtcaatgtggagtaaattcaagttttgctttttggaatttccaggaattttttttcaaatatgttcagttctgtggttggttgaatccatggatgtggaacccacagatacagaggccgactgctaaaacatggataaacctcaaaaacattacgctcagtgaaagaagccagacacaagaccacatacggtatgattccattcatataaagtctccagataaagtcaagtgtatagagacaaaaagtaaattagtagttcccattgactcagtggtaagaatctgcctgtactgcaggagacaaggaaaacacaggctccatccccgggtcgggaagatctcctggaggaggaaatggcaacccactccagtattcttgcctggagaatctcatggacaaaagagcctggcgagctataggccagggagttgcaaaagagtaggacaggactgagcgactgagcatacacaagaccaaggtggggatgggactgaccacatgtgcccacgagggaactttgggggatcatggagatgttttaaaattggagtgtggtgaaagctgcacttgtgtaaatgctcagacgtgtccgactctttgtggccccaggcccctccgtccatgggatttcccaggtaagaatgctggagtgggttgtcatttccttctttgtgggatctttctgacccaggggtctcctaccttggcaggcgaattctttaccactgagccatctgggaagcctggttaaggctgaaaagctctgaatgtttaccagaaatcactgaattgtttctacatgaactgggtgaattttaaggtatgtaaatcacacctcaagagcattaatgctgaacatcaacttccctgagatacagtgaaacaaaatgaatggaactaactcaaaacccaccactgacctctcccagctgcaattctgctttctgcccacagctcttaactcatctctttcttaataagcctacagagaattcgaaggctctgtgctagaatggcagctctctgtattgttagaaaggattaccaaaagataaagagagagggcagtgtaatagactcctatggaagatggttcaagagtctgccaaattgaccctaagaataaactatccagatctcaagaccctccaggcaaggcagacgtgatggtggcaggagtcaaaacaggagggcaaagcacgagttctgaagacccccgcactgcagcccagctgggagaagggagagggagccaagtgtttttgctgcagaaaactgtttatttttatttgttcttcagcccagctgggatctgggagaagtggcaacaggaaatagaaatgaagccaatacaaactgggcaagttcaactgtgctgacttttttttttttttgcaaaagcgctggtaagacatttctagcagcaagaaaacctcatttcctttctcaacgtgcttaacagaagtcttctgggggatgtcccaggacgttcctacattgtgaatattccacgagcaggaggccctggtgcctttgtgagcgtcagcagcaggggtcacttttcagggcggcacggtgacattactggaggtggtggacactgcccagcccttccccaggaatgccccttggccaacaagcccactgctggtcccaggacccctggtggtaccccggagagctgagctgtgctgccccgggtgctttctgatgaaacaggctctccatcacttctgcaccctgatccctcggcaggcgtgagctttctctgcaggagtggtgcttctttcccatgtctcatctcttggcttgttctcaagatacagtaggaggagagctgggatccctgaaaatgccagaggcttttcaatgcaggaaagacggactgctcagaaatgaaggacattgtgggatgagttttgcagaataaaacgtgaattgcctgtgtatgctatagattgggcttcccttgtggctcagctggtaaagaatccgcttgtgatgtgggagacctgggtacgatccctgggttgggaagatcccctggagaagggaaaggccacccactccagtattctagcctggagaacttcatggactgtatagtctatggggtcacaagactcggacatgactgagcgactttcacttttccacatgctatagctacaggaaacttgcccatttactgctggaaaatggctctcacggtgggagaatcttttcggacctttaaaataacaacagttatgaacacacctgtcagattctcgtatgtcctgtttcaaactgattcagaataaggacagacgctgggtgtgaattactaccaccccacaaacccatctccatttgaggtgaaaagtgttagttgctcagtcctgtctgactctttgtgaccccttggactgcagcccaccgggctcctccgcccatggaattctccaggcaagaatactggactgagttgccatgccctcctccaggggatcttccagacccagggatcaaacctgggtttcctgtattgcaggtgaagtctttactgtctgaacgactgggggagccagcaaaccacttttcatggagctcccactgagcgtgggctcctgtgctcagcatttaaatcacgcctctcgtgcagtcctcttagcgaagatgtgtaacacccccatccctgcagatgggaaactggggctcagagacgcacgatcacctagtcaagagtgacgcttcaattcctagtctcactcatacatgcccttgctctcttctgtgacacggggacattcagcctctggcaactggataaaggagaggatgagacggttggatggcatcaccaacccagtgagtgtgagcaagctctggagatggtgaaggacagagaggcctggtgtgctgcagtccacggggtcccaaagagccggacacgactgagtgactgaacaaccaccaccaccaagacacaaagcgattcccactcagatcgtccctctcaagtctgttacataaaaccagagatgatgattctaatgggctccaatggtttgctaaatttaggcaggcccccttcccgaatttattttctccctgaatgagtctgtgtcaagcctggaccagagcagctttaataaagaagcctccacgggttgaaatgagagccccaagtaatttttcacatcagagacaaaagagacctctgctttactgctgttgtttttcactaggcacccacattgcacaggcatctccgaatcctggcatcccctcatcctgcctgtcccaaacctgcaccacccattcctcctgtcctcagtcccagcactttctatccctcctgtcccccaatgccagcacctactgaaggaggtaccccgcattctggcaccaccatccttcttgtccccacatcctcttggtgcccacctcctgggaggagccgcagactcctcatgaggtctgcatgtttcctgtccctctcagaaactgtcagggcagggatgcaggatgttcctctttctcagtgaccctcaggatcactggctttgggcccagggagaagtcctctccgagaaggagagggggaaaagctgatcaagttctctgggtctgcctcctcctattaggaagaaagtctaaaacctaatcccacccaagaagtgtggctaataactaaattggataaaaactgagagccaggacctcatgcattaaagaagagtgctcaagcaaagcaaagcaaaagagtgctcaaaacagagcaaaagagtgctcaagcaaaacacctcccagcacaatctatgaccaagggtctgacatcagccagacccgccacctacagttcaaagagcaaaaggcctgcaccctggatcactcccctgagggtacacggagaggctgaaactctagcccagccaaggagcagtgagggagggagaagcaggattaactgaagccaaaaaataggaggcatgttcttattaaaatgcaaattacttacgttcccagaaaaaaccctccaaaggctcccctctgcccttagtgttaagttgctaagtcatgtccagctctctgtgacccctggactgtagcctaccaggctcctctgtccgtgggattttcccaagcaagaatgctggagagggttatcactgccttctccaggggatcttcccaacccagggattgaactcaggtctcctgtactgcaggcggattcttttactgtctcagccaccaggtgccctcagctacaagccaatcctcagtctcccatctccgagggccctcagccctgtgctcacctcccagtatttgcctgcccttcaccttgctgactcttactcacctggtctcacttgacccactcccctgggaagccctcctggtctgctacatcaccggggtctggaatcaccacattccatcccatgagggcaaggaacacagtgctcacccacaccccaacccaaggagtggggtactgggtgggcacctcaagattgctgggcaggaccgcaaagccccagtggagaccacagttagaagccgggtattggaacagacatcagtggggtggaccttcctggccctgatagctcagtgggtaaagaatccgcctgcaatgcaggagacccctggttcgattcctgggtcaggaagatcctctggagaagggatagctacccactccagtattcttgggcttccttggtggctccgctggtaaaggatccgcctgccatgtgggagacctgggttacatccctgggttgggatgtaacattacattcctgggttgggaagatcccctggagaaaggaaagactacccactccaggattctggcctggagaattccatggactgtatagtccctggggtcacaaagagtcagacgtgactgagcgactttccttcacttccctgaggctcttatgtaagagcatcttgtttagggtgggaggttggctgggccgctctctggcagccaagtttataatcatatcatgtcacatggtctctggccaaggcagatcacaggagggggctacctgaccccagtccagccaaagaaacagctctctggtaggaatttggaaggaagttgccagattggtagtctttataaattgttaggacagaaaagtgtaacttaagaatcgcctgggttgtggggatgactgtatgccatctagcccaggctcagagaaaagccgtagaggggagagagaggagcagagagacagacagacagagagactccatgctcgcgaagttccagtttagtcccgccctgaggctttctttcctggtctggcttctgaagatggctttctacccgtaggctacctccccaaccaactcacttcgggcttaaaccagctcaaatcggtttcttcgctcatatccaaaggagtaagacagatccgcttagaaattaattcctgacttccttcttttctgtatgaacttccacattagtgggaatatgtttttttttttaaacataaaatgcccccattccacgccccattcggtgatctaaaaaaaatacacagacattgcaaatcactttctaatgattcgagtttcacagtgacaacccatccgtcaaggggagaaatgattttaaaatgtcaaccactttgaaggtgattagaagtgatgagaagttgcctgagaaggcatctgtttggatgggggagcagggaggagaggttggggaccctgagttgctcagagagtgagagtcaccccctcccctttagaataactcctggagaaccacagggaagacaaggggggaactgtccatggtcccacatctgaaaccaaaaagcaaagccccctctctgacctcggcctcctatcctccaatgaactcactcagatgcctcccctgccatcctctgacctcatccgaggagcccttgtttccccgccagccctcatgcatccggctggatgtacccaccaaccagcgtccccgagaacttggaccactaaccccgcaggccctcggcacacccagctcacatcaccaccatccttcctgaagtcagcctgtcctccggcccccacagccctcacttcagactttgatctcctctatcccctctcccctccccgctgccccatcctcacagccgaccaccccggctcacacttcttttgagaagacgggagccacgcagttggaactccaagccgtccctccatccatttccagagtgtctgctcccacctccatggtgagaaaggacatgtcctctggccctcgccaccttctctggaccccaatctttccaaataggccaggtgcctccagcgtctcaaattatcttcctactttcccaaacctctccaatccgcccaacgtttaccatgtcttctagcccgcttccagtcgaactggtctctgcgtccatcccatccagcccaccctctttcagctggagcggtcctttaagactctaaacatcatcaccgaacgagtctcccactggcacctcctcccaggcctcacaggacctgattctggccccctcctgtaccatcttacccacctccgtcctcacccactcacccctcctctcccactcagcatctgccagctcacgcctccccacccctcagagcacaggggcaaattcacctccaaggaaggttctctgtggaagatttctccaccttccccacaaactaaaaggcccctccaccattatccttctgcacagcatcctggcctttccttaaaacaaacaaacaaacaaacttatttggctgcactgggtcttacttgcggcatgtggattctccctgaccaggggtctaacctcggggcccccgcactgggagctgagtcctagccactggaccaccagggaagtcccatcctgccctttgctgaagcatcatcattcatcacagtgggtaaagagagatttctctggtgatttgtttaatgctcatctctcttcccccagggcttccctcatggctcagatggtaaagaatctgcctgctatgtgggagacctgggttcgatcctttcccctggaggaaggcatggcaacccacttcttgcctggagaatccatggacagaggagcctggcaggctacagtccatggggtcacaaagagtccgacacaactgagccattaagagcatctctcttcctccacaattcgtaacggcgtcttttcttttttaactaaaacataccaacaacgtgctgaatgagtgaatgaaggagaggaagcttgggctgggatgtgtgactcctcaggtcctgaaagcccaccctgtcttagttaaaaggagcctcagcctgggcacggccctcgcctcgcccatgaaggcacatcaggaaatccaccttatttgcaggttaccgtcctgcccttccttccacgttcagcaagagacctgcagttactggaacttcagacagatctgtgcagcttcttggggtttcccaggtggcgctagtggtaaagaacctgcctgctaatgcacgagacatagagacgcaggctccatccctgagtgcggaagatcccctggaggagagcacggcaacccactccagcattcttgccttggagaatcccatggacagaggagcctggcaaggctgcagtccacggggtcacacagagtcggacacgactgaagcgatttagaacacacatgtgacttcttgagtttcttgaggaaactcaaccagaataggttccaggctacccagagctgcttcacacgggaaccagtaaagactggaaggcaaatcaaaccgtgcctcctggaacgtgaatgtgggcgctattattttgggactgtatttctgtagttacttcactgtacctattccagctctgatattgcagaggacatatttagctcaggatataaaatgctgtggttgcaacaaaatattattgagctgtaaaaaggaatgatgtactggcatgtactccaccatagatgcaccctgaggacatactaggtaaagaagccagtcacagagaatcacacattgtccaactccattcatacgaaatgtccagaagaggtaaatccataagatcggaagtggtggttgcttgaggtgggactagggggcgaggggtggattgggggaggactgctaaagggtccagggtttctttgggatgtgatgagactgttcttaaatttttaaaaattttcatttattttactgactgtgcatatatgatcttagttccctgaccagggatcgaacttctaccccttcagtaaaagcttggaatcttaaccactggactgctggggaattcccaagaatgttcttaagttaattgcaatgggagttgcacaattctgtgactctattgagaccactgatttgtatgattaaggggtcaactgtatagtttgtgatttatagctcaataaagctgtttaaaaaaagaagaagaagaaaaggctaggggtacctggcagggagaaagaggtttccatgagcacaagtattgggttcttcagttatgacgttctttgcttttcctttgcttctatacttatttgaaaacaaaaacaaaaacccctcagcagtccacgtgtcaggattacaaactagaaatccatggtgccctcagggggtaattaacacttgatttataaatgtcgctttataaaattggaatcaattgaaccaagaatttcattttatgattggaagacactaggaaaaaaaagtaaggctgtcatgtaacatatttaaaggctataggtaagcatttgatctgttggcttaaccccagggatacatcgataaaatggctattggcagtccagagaattagtcattttagggcccaaacgcaagactggaagattaactaggagtcaagcaatactccgtgaacttacatgacatatctataaattctagagcctcctgagaactcagattaaaatcgttcttctcggtgacatccgctttatcccgtttccttattcttctccttccctcccctcttgctgccaatctgattactaaaatcacttttcttttttttggccatgtggcatgcatgatcttagtttccctactagggatcgaacccatgtcccctgcagtggaagggcagagtactaaccactgaaccacagggaagtccagctaaaagcacctttgacccaagaaaattctatcgcttatgacatggacattataaacgaggataaaggacaggaggaagcctcatgagtgtgagagaagacaacacagtgtcagggtgtgttgggcagatgccatgacttgttgctccaaacctccttctgttcacacgaccaccgcctcccccggaggcaaaatctccaaaaggctggcggagggtgtatccttaccacacgcgtagaagaccgagagatattttttcactcctggcagacaggggcttccgaaatggtggttgttgacgaggactttgcacctctgcttcccgtaacatctcctggataacacgtgcagagccgagtaagacagacaatctgagaggcaggagacatcaaaaacttttaggttagaatccatgtatggcttcggttcttttctgagccggacttcacagttcatggagatcagctgtgattattcgattattttccgtctcattaaagcaccccacagaaggctgaatactatacaggcagtgctggaagggcttaatcagcttgctctaatactctgctgtcatggtctgaaaacctatctatatatcatattgtgttatatattataatattagcgatttactaaaattttgttttctttttagtttttattggaatataattgctttacataatgctgtgttagtttctgccgtacaacaccgtgaatcagctacaggtatacacccaccccctccctcttgagcgctccactcagccacacccccatcccagccttctaggccaccaccgagcacaggattgagttcccgtgctgtggcagcttcccaccaactgttgtacacacagcagcgtgcatctgtcaatgctcctcttccagttcactgcccctctcgtttcccccggctgtgtccacagttcagttctctgcgtccatgtctctatttctgccctgcaaataagttcatctgtaccatttttcttgattctgtatatatgcattaatgtgcgatatctgtttttctctttttgacttcactctgtatgacagactctacgtgcacccacgtctctacaaatgagcccatcagaaatccttatacatttttgaacaagggggcctacatctgcattttacactgcctctgcccagtcatgtaaccggtcttgcatacacagcaggcaaaacgtgtaaaacactgaataaagactctttcttttactcctttagtttagttattggttactgctctttgaaacagtttagttattggttgattttgagaatccttctctcctatgtgaacataagcactgtgaggacaggggctatttctattttgttcatcatctaatttttccggcctgaccagctgtggaaatccaatagctgatgaatgaatgaacgggcagatggatgaagaaacatttggccagctttttcggcactctggcacaagatcttcaccgttactaaatattaactgaacacgtatggagaatgaggcactgcgtcatgtgcagtccaaagaaaacaaccgagagaagcccgccatgagtccacaggatgtgcgatggggctggaagacagagcccattcaggtgacctgccgtctagcaacgtgaaacagggtgagtaccagcagtgatggtttagacaggacgtgacggggtcggaggaggcagagattgctggggaccagagtggccaagacaggccttacggaggagggggcttggtccttggagaaggagcatgaccagggtaccggcaggccaagagagaaaggcacaaacaccaaagtcagtgagccggaagcgcttagcgggcgtctcagggctgagcctgagctggaatagcaggtgcgggcaggtaagttgcaatactcgatgaggaaaagtaaaagacagcaaggtccaacttcttctgaaagctgagctagagactttgagctctattctgcaagtgccaggggccccaagaaacaccctgatgcttgcgtcctttggggacatcgctattgggtgccctgggagagacaaggaaccagagggagggagactggtttggaagcaattttaatcatacctgttgggaggaattaagggcttgaacagcagggaacagagagggagagaattctagagaccctgcaaagttcagctcagttacggtaacagcaagcattctgctgaggctgtgtttcactcgtgtgtctcatgagataggttgttgattatacatcttatatttcatagaaaatatacagagaatatgatatattattagtatcataagttgtttatataacaatatgcagctagataaaggtggggaagctcacatctcagagaagttccatctctccctcttatattaatattttagagatccgtaagagtccagttgaaagcaagaatctgtggtaaacaccagagaggtgggaagacaatgatcttaaggaaatgacgattaaataaatacatacacacatatatgaaacatataaattagatatatttatttatatgtgtttattttatattctcacatataataatatatggagcatgcttatatggaccatataaacatatatgtataaatgtgtgtgtgtatatatatgggcatatatatgaatatatatgtacatatttttgcaacatagcttgtttggtttagttgctaagtcatgtccaactcttttgttaccccatggactgcagcccaccaggctcctctgtccgttggattttccaggcaagaacactggagtgggttgccatttccttctccatgttatatacctaaaagtatgtaatatgtatatctcaacaaatgatgaggaacattattatgaaggcacttgatctgaatatcttcatgaaggttctggtttatttgccaagtctaatcccacaatgcctgatcactggagtgcatggcacacggtaggcagccaacaatgatgaattcaatgaatggaccggtggactggcctggacaccaggaaatgcaaacatcccatacacctggctttggaatgtgttctgggagggtgacccatgagttcgaatctacgctgagaaaagctgcctgaaggggccgtcggaagctgtcatcctctttttggcccctgggtcagttctacttggcaacttgcatctgttttctgactgcgtctgaatacttcagtctaaaggacgcatcttgctgggctaaatttgttggggttctcataaatgacagagaagtaaactgagcaagtcaggcagccattgaggatggaaggtgaggttttgaagtgccagagcatcaagcatgtctctgtcaagagtaaagactaacagcctgaacagtgttctggcagcccacccagggctcaaatcagaccacataaagtgggcttgataaagagattttacaaaggcgtgaatgggatatgaacccctcaaaggatggtgcagggccctgaggaggaacagcagagagaggctaccagccccgagcctgaggggcgagggtaggggtttccaggacacaggctgccccaccgagcgggctgctgcatggagctgggtctgcagtgggcgctccctgtgagtcgtgttgtgttcccttagccgcttttgtgcctggatctgtcattggatggggagctcctggagggctctggggtttctctgctgtttgcccagaacctactatctgttcaactccctgagactctgtgttcctcccccagagctagaggaacatcatttttaccgtctttctgtgagacttgtgcaaagcaactgcaggagtcaaagcgcacataaatgtgaactgctctcaccagctgtcgctgaggttgaatgagctccctcgctgagcctgtttcctcagcgggacagtgaccatacggagagcagtgctgatttactggctggcatgagtactgcacgaaggttacatttagagggcccagtggcagcatccggtgttcgtcagttaccgtgactgacatcgggccactacctcagatgggaaagcggcacttctacaaaaggcctttgggacttagataatttatagtctgaactaaatgccttctttggttctttcaagtgaaaacaggcatgtggaatgatgagatatactatatactacacacacaaatactggaaggagaatcactaagattctcagggggctatttttggctgatgagaaagaatttcttcccccctattgattttaagatactttccaagtttttgtgagtttacattgctttgaaatgaaagcgtacaaaatgaactttcttaaaaagaaaaacaaaattcatatctggatagaagacagattttaaatatgagtgtctctggggtaatttttttcagaaatgtaaatttttctgcaaatgtaatgataaatgatcctttgtatacctcaatttgccccaggagctatgggaagtttatctaggagtaaagatatatcctttgaattttcttcccgtttacttaaaattttttattgaagtaggattaatttacaatgttgcgttagtttcaagcgtatagcaaagtgattcagttacacatatatgttctttttcagatcctttgccattacaggttattacaagacactgaatgtagtttcctgtgctacacagtaggtccttgttgcttacctgctttatgtatagtagtgtgtatctgttaatcccaaactcctaatttatctccctagtactcttgcctggaaagtcccatggacggaggagcctggtgggctgcagtccatggggtcgctaagattcagacacgactgagggacttcactctcacttttcactgtcctgcattggagaaggaaatggcaacccgctccagtgttcttgcctggagaatcccatggacggaggagcctggtgggctgctgtctatggggttgcacagagtcggacacgactgaagtgacttagcagcagcagcagcagcagtcccctgtagttcatttttttttttttactatttttcattgctttgtgggtgcacagggttgattatgaatatttttgctgtttttaggagccttattattatttggacatttatcaattggaaatttatctattattagcacatttatcaattggaaaaaaccctacatctcaagattgagaatgagctgtatgacttccgtataagccacctatattgaaaagaagtaacaaaagaattatgaagttattcttggaagtccaacaactattattgtttttttgtttcaaatacatgtttatagccgaaaacttgaaaaccacaagtactgctaaaccaggaaaataaaaatcctcagtaaattccataatcaagaaaaacaatggctaacctttaaagagcatccttctagtcacttttctatatttaaatatccttccccctcaatggatcatatacatatgactctgtatgctgcttttcctcatttattagcatatttatgaaaattttttaacagaagcatcattttaaagagttgtatagtttctcactttataaatgtgccagctctatttacaataccctattggtagatgttccgatggtttccattgtttaatgccataaagaattgtgcgtgaaacatccttagagccaaatacttgcacacgagcatgacggtttctaactcttggaagtagattgctttgtcaaagggtattcaaaatattaaagcttttgatacatgctgccaagccgttcagaagggttgtatcaattcacactcttgccagaaatgtctgagagccccagaaactttatattttcttaggatgtgtgcctgaccatatttcttaaggctaacagaggaaaagcgtggggaagactctatttgcaagaccacaatcctcttggacccaggaggtcctgtgaccagtgtgatttgcagagacaggcttctgcactcatagttaccctgggagccaaagaatttatcttggtgagagtgaaagaacccacggtgtatttttaggaagaggcccaaggtaattcaggtcctatgtagctctgaccatttccttgttgacactgagcgctgaaccattggcaggattcttttttttttttttttaagtggttatttccctcccagcctgattttgtttgcacctctctgcctggcaaactaccctccgccccaatacatgtgataacaagatactcaactatttaatttttatatttttggctaccatttcacactgaaactgcatttaatcgctctttacaacctgtgtttatttagataattaggcgggttgctcttacgagacttcttggcagtgagagcccctggcaccttgatctttggctgaaaagtccaggcctgcccacacttggccgtggggtggccttagtccagcctttgagacccactgtgtggtttttctcactctcttattaaggaaatagcacccctggagcccacccagaaagtataactgctgcaggaaatgacgtgccatggtggacacccagggagcttcctggaagcctgccttccagagtccatgcccaggtctgtgggaaggcgtatcctttcttgtgtcagatgctgctccactggggtttctctgagaccagcgctgatcagccacttttctattttctttcagtttcttttccaatacaggagccataacttcttttttaaaaaaaatttggctgcaccacgtgacacgtgggatcttagttccctgaccaggaatcaaacctgtgccccctgcattggaagctcagagtcttaaccactgaacctccaggggaatcccaaaaggagctgtaagttctgaaggatctgacttgcctgaagatctttcagaaatgtctttgcatcatcgctttcaatagagacaccagatctgtgtttaaacttgtatgacagttcagttcagttcagttcagttcagtcgctcagtcgtgtctgactctctgagaccccatgtactgcggtgcaccaggcttccctgtccatcaccaactcccggagcttactcaaactcatgtccatcgtgtcggtgatgacatccaaccatcttatcccctgaagtccccttcttctcctgccctcaatctttcccagcatcagggtcttttcaaatgagtcagctcttcgcattaggtggccaaagtattggagtttcagcttccgcatcagtccttccaatgaacacccaggactcatctcctttagaatggactggttggatctccctgcagtccaagggactctcaggagtcttctccaacaccatggttcaaaagcatcacttttttgacagctggcgtggtcatcagccttgctgctctttctaatttttttgcttgaaagctgtgatgatcagcctttgtgttagttcctggggctgcagtaacagagaacacacactgggtgccttaaacaatagacttctgtgtcctctcagttctgaggcgggaagctggagctatcctgcgggttggccccttctgaggatccctttcttgcaagtggccgacctctccttgcgccctcacggtgtcttccctgtgtgcacccgtgtcctgagctccccttcctgtgaggacagcggtcacactggatgagggccctccttatattacctcaaattagtcactgttttaaaggcgcatctcctcaaacagtcacattctgaggtactgggggttaggacgtcgacaaggggattttagggggacacagttcagcccacaacagccttccggatggccctccacggaactcacatccacatgtagcctcctccctcaaggaatcagctggtctctgtgacggcagactctggagaggtgacagggtgtggcttccatttgctcctctgcctctcgggctctggaagaagccggctgccatgttgcaaggacgctcaagagacccaagttgagagaaccaaggccacccgtgaacaatcagcaccaacctgtgcatcacataagggagcctccttggatgctcagccctcagatgaccgcaccccaagccgatagcctggctgcaactccgcgaggcctcacgagaccctaagtaagaacttcccaaccaggctaccctggaacccctgccccccagaaactgtgaggcgctaactgttcgtttttgttttgagccattaaacttgggagtatttcgttacattgcaatagcctctggagcacagtggctagtaacgctgcagcacgccaggcctccctgtccttcactgtctcccagagtttgctcaagttcacgtccactgagtcggtgatgctacgtaaccgcctcatcctcttgccgagtaactgagagctgaagccttgctccgctctgcttcctgactgagtgtgccaatctgcactgggtacccagactccgagcctgcgggactgccccagactttagcttatatcacaagaggaaaagcacacatgtccccttgcagaggcccacggcgagccctgaccacttggcgttcaggcagctatcattccaagttcatgccaggttccagggccaaaaataaacagccctttctccttcttcaaagcgctaaggctgagccacagtaataactggcaaccgagagcacagctctcacgccggcggcccttggaccggatggggcctgtaggcatgttttatttggctctcacagtattttaaaagttgggaaactttacattttaaaaaaaatcagattttcagtatctcccgagaggttggaagctatgacaacaccaggcccacataccaagccagcaaccatccacttgctgagcccagcgtaggcgcctcacttaggaacagggtaggggtggttctaattcattcatggggcttaagattcactcgggcacctactctgggccaggccctgctctgctggctgggaatcctcatggcagagacacacagcacctctgcagtgctggcctgctcctgggcagagagaccacaagcacctaagtgactccagactgtgaagacagtcagacaaggacagctcgaggcggagaccagggcgaggtgccatggtggcagggtgcctcggaagatctctgagatgatgtccgagcggactcccgaatgatgaaatgaagctgaccatacaaagatgtggggtgagaacatcccagcccaaaggcagagcttgtgcaaaggcactgtggtgtgaatgagtgtggagggctccagaggcgggaccacaactggggactggatttattctaattacagaagacagagtggggggctgtgatctgagttgccttagaaaagctccttccaactgctaacaaagaagtggctaagggagggaacagaatcaaggagaagggaggaggcccagatggtctagatgagagaagtccagagtggggtgggagcaaacgggctggatttgggatcctgagagcagggagtgcccacaagacttgcagatgcagcggaaggggcatggggtcaaaagagggagtccagctttctaaagtgggggatattaaagtgtgcttacaccagatgggaaactgacgattctgtgggacaaacacgccaagtgcggtttaaagccttcatggacagtttacctgtgccgaggagtagagaatttcttagcattcagtaagattaagaaagttcattggcccaggaagccaaggtttcctggctccgcatacatgcacagtcccgcccttcggtgctaacccaaaaggcgagcaccgagtcgaggcctccacagggagctgggagacaagatgaacgggcacttccagcctgagtgggagaaggtttgggggagaatggatccatgtacatgtatggctgagcccctctgctgttcccctgaaactaccacaacactgttgattggctatattctgatacaaaatgcttttgctgctaaaaaaaaaaatcaatgggcatttgagatggtgagtggacagggacccaagatggtgagatggatgggcactttcaaggaccctttcatgttcccctggacccgttcacacggcagagctcagcgcctgtgggtctctgacactgggtgtcggctcatgaatgcagttgtgggggtggtgaggggagagggcaggggttttacgatgtgactcgggcagggcttcaagcttttaaaactgaccagccaagccaagggctcagtgtcccattcacagacttttccccgagtcaacaaggcttattcacgactgacccaaggattccttgaactctccatgggaacctgtcttttagccacagtgtctgttaatgttttctttggctgatgacttttcacttttaacctaactcctgaatgcaacttcccaggaatgtaaggcagcaacttccagaacatgtcattcagccagcatgtggatctaccaacttctgctcagaagaacccctgattaatattaagtgaccccacaccaaggttaagaagtgtaattcctttctgtagatagaggtcgagttatccggggtgccttgttcagctaagcaaactagaggacacagggagcccctgaaggacgtgcaaggggtcagtgatcagactggccctttagaaggctgcttccggccaccctggggggaaagccatgtctaggggcagggggcctcctgagatgaccaggcaatggtcccttgatctaacgcagcagcaggaacaagggaggacggggtagagacatgaacgcttgcagatgttatacgagagggaaattggagtttccaaactcacaggtcacttgctggggccccaggcatggacagacagggggagccaccctcgtgagtgtctctctacccacatggcagccaagcctgtcaaaatgggggctaattaagagaggccagatgcccacttcaggctgcttctgctgtctgctgggctgcccttcagacaccctccaccctcccgaccaagggccttccttccctgaatgctgggcaaggggcctcggagacatgggacacgtgttccttgtgaactggtttttggttctccctctagagagtctgcctgtgtgactaggtcactttctttccttcccccacctcccccccagatccaagatatcacttacacatgaacttctttttaaaattaatgtttcatttcacatgtgatccagggatccactctagcaatttaacacatcaaggagctcgtttcagatttgatgagtgaagtgcaccttttttgctgtttcccaatcgagtctgttctccctggtaacacggagggtctaggcgaggctgcttcaccaccgcagactggggactgggatcgttcacttcgtgtgtcatttcagccagactacggtgcccaggggtttggtcagacaccagtctagatgttgtttcgaaggcatttttaagatacgactgacattagacatagagaagaaacttatgattatcacaggagtaaagagatgggatagattagggatctggagttaacagatgcattacatctaaaatagatcaaccacaagcacctgctgtagagcacagggaattatactcagtatcttgtaataacctacaatggaaaagaatctgtaaaaggtggcaaaaggtaaagagtccacctgccagtgcaggagacgaaagagacgcagatttgatcctcgggtggggagatcccctggagggggaaatggcaacccactccagtattcttgcctggagaatcccatggatggaggagcctggtgggctacagcctatggggtcccaaagagtcagacacaactgagtgactgagcacacatgtatataaaactgaatcactttgctgtacacctgaaacaccgcatttaaattttaaaaagatatgactaacattaaatcagcagactttgagcaaagcaggtcaccctccataacctgagtggacctcaaccgacccatggaaggctttaagagcaaagacaggtcatctgaaaaagcttttctccaggctgaaatacaaaactctacccatatttccagtctgctgtcctgtggaattcagactcaagactgaacatcaactcttacctgctttttcagactgccaacctgccctgcagatgcaaacttgccaggccccacaactgcgtgagtcaattttttaaaagcagtctatctatctaccacctactggttctgtttctctggagaaccctaatgataatagaaggtgactttgaagggtggaatgtttccctggtggctcagatggtaaagaatctgcctgcaatgcaggagacctgggttcgatccctggaggggcgatcccctgggggagggcatggcaacccactccagtattcttgcctggagaatcccatggatggaggagcctggtgggctacagcctatggggtcccaaagagtcagacacaactgagtgactgagcacacatgtatataaaactgaatcactttgctgtacacctgaaacaccgcatttaaattttaaaaagatatgactaacattaaatcagcagactttgagcaaagcaggtcaccctccataacctgagtggacctcaaccgacccatggaaggctttaagagcaaagacaggtcatctgaaaaagcttttctccaggctgaaatacaaaactctacccatatttccagtctgctgtcctgtggaattcagactcaagactgaacatcaactcttacctgctttttcagactgccaacctgccctgcagatgcaaacttgccaggccccacaactgcgtgagtcaattttttaaaagcagtctatctatctaccacctactggttctgtttctctggagaaccctaatgataatagaaggtgactttgaagggtggaatgtttccctggtggctcagatggtaaagaatctgcctgcaatgcaggagacctgggttcgatccctggaggggcgatcccctgggggagggcatggcaacccactccagtattcttgcctggagaatcccatggacagaggagcctggtgggctacagtccatgggattgcaaagagtcggacacagttgagcgacttgaatgatggcctttcagacgtcgtcttagctccacactgcagatttctcagaatgactcattgagctcttcttcagcctacaggctcagagccttgcacggctcttctctccacctggacaccttccccagggtctgcaagctctcctcctcgcatctctgctcagcatgcccatcacccctttaccctgtgcctccctgcagtaccccccacctgccggcctgccctctctcctttcctcacgtgcttgtacccctaatgcttatcaacacctgaaatgtgatgtattcgctcgtgcattatctgctttcgtgtcgcatccttgtctactgcgggaaggtcagctccagatagactgtcggtcactaatgactctcccaagcctggaatgggccttgcgtacagtaggcactcaataatgatgagatgcagactaactcaaagacagactgattacgcaaggagtgggggggggggcggtgcagaaggaggcagaccctggtgagtggttccccttgcccttgactttctctctagtcagggtaccagccagtggggaccagagccccagtctccccaacagcaccctgatagcacccacataagacacttaccaaagggggggagccgctcggcttccgaggagcagacatgcctctcctgggtcctcctgccgtaggtcgcagagtagatgttgagaaacttggactcgtggcagtgcagtttcagctcgtggtcttcacacacagttttgttttttaactcatctgaagcagaaaccaaaatcagcggcaccatcagcttccccagaaggactccgtgagcattgcccgaatcccaggaggctcccatcctctgtggggctgcacccccggaaggggacagacggtgtggccctgcctgccaggggctctctgaccctgcgagccttctgcggggggcgggggggagcaatgagtggaccaggatagacacccagggattacgccaaggaccaaactgaggaggaggagagacgtcagggtgaagaggccagggcgtgctgggccagtcctaggacaagcctggccataaagggagttcctctccctccccacctgaagacacagatttcttggttcaagggagccttttctcaaatgtcatctagggacccacacagctgcgtgctcagtccctcagctgtgtccatctcttctcgaccccatggactgtagcctgccaggctcctctgtccatggaatttcccaggcaagaatcctggaggggttgccgtttcctcctccagggatcttcctggcccaggaattgaacctgcgtctcttgagtctcctgtattggccagagggttctttaccattagtgtcacttgggaagcccccacacaggtaaagaccaagaataatctcagagggagtccagctaaacctcaccacccaacttcacagcattctcacatcccatttgtgtatctaccaagagacggagaaaatatggacaagcaaattatttccttttctaggagcaaaaaacaaggcaccatgtctgtgaacgatccctccttgaaacacaagatcctatctcacagcatggggaactacagccagcagcatgtgatagaccctaatggaaaagaatatgaaaaaaaaaaaaaaaagaacccctcttcggaggtgtgaagagctggttccaagttcggcaattcgggaacaacgggccctcttgctggcgggggtcccaggagaggaagattccagctcatggttggttagtccccaaagaatttaataaaagtttgtttaatctgagtaccatagtgaaattctctttgcaacattatacagaggtgacattataactgcatcctggagaaaatagacttcactgggttttttttatggagtataccccaaaaaaattcaattaatttaaatgtttactaatgaatggatttttttaagtagtagtgttcttgcctggagaatctcagggatgggggagcctggtgggctgccgtctatggggtcacacagagttggacacgactgaagcaacttagcagcagcagcagtattttttaagtaataatagtacttaatattgaataataatacattataatactagtactaaaaataataacaccacagatgcaaaagactacctaatatgtggttccatttctgtgagatatccagaaaaggcaaacctgtagagacagagcaaaggtttgcggttttctgaggctgagggttggggacatgaagtgaccatgacaaacgaacaccgggaagtatttggagaggatggaaaggttctgtagctggactgatgggctagttgcacaactcagtacaactactaaaaatagttgagctggacacttaagtgaacgctatgctatgtaaattatacctcagcaaagacatttctgtcttatttttatttatgtggctgtgctgggtcttagttgcaggatcttctgtctccgttggcctgtgggatctttagttgcaacatgcaaacaaactctcagctgtgacatgtgggatctagttccctgaccaggaatcgaaccccaggctgcctgcattgggagggtggagtcttagccactggaccactagggaagtcccaacaaagatatttttaaaataacaacagctaatatttactgagccctttctctgaacttgggccttgttctaggatcttggtatgtctcagtgaatttaataatcaaaacagcccttatgtgaaccacctcttcttatcctttgcatgttatgctttggatttttagaaaatcgtttgtaggaaggattcatagatgctggatgctaacttttgaactttcctctcttacatgtgataaatctcttttcttagcctcccacttattttggactttgcaaaataaaagcagaggaaaacctgagggggaccatggttatttctttgcatgtgtggttctctcccgcccccatctaaatatttttattaaaaaaaatcatgaaaaaatgttagccccactctatcacctcaatcctagtttttttctattttgaaatggcaaccaggggcacacctttcagccagacaagcactggtgtccctagcaaacaagagctaaattccaggatggggaggaagaacaaggaaagctagtccacacctcccatcgcccccatgccccccttttatttctctctcccactcatgtttttattccacttttctctcctggattggacgtgcaggctgatccctcaaatcaaagttttccagttgtcatctgaggcccatcatgaaatcagtttagtgagtcacgattagaaatttaaaaaaaaaaaaaaaagaatagttcagaaaacatcaaagcacatcatacaaagtaaagataaacactgtttaataacggattccttttagttgtgtgtggttatgttgggccaaaaggcaaaatgtttttcttactctgggttgcgatcaaaccattctgaaattccctgaaggagaaggcgagagcagtaaacatcagggcaaaggtggccagtgggaccttcatatcctggaattaccgaagcataagtcccaatcttaaaacatgaaagaaaataatttcctagtagaaattccacctttcggtaacttgtaaatccccatgcctaaaaacacagaaggagcagtgaggcaaagcttttgaagtgcttgaaggaaaaattttagtatctcaagattaccatcagctccggtgctggaaaacttgggcaatggttccttagaacacgttgatgggaagattcatgagtgagagatgtagagcggaaagcaagttacagatgttcccagaatccccatcctgtttaggatctgcacatacctgtgaggacccatcagaggagggaaaaatcaagtgatgactaagcaaatgtttcagaagtcctttacccaacactgaaatcttaataaagcagtttaaacttagagccgagaaaagttttgttttctttttcttaataaaaggaacatggagtctgaccttgacattggaaggtctgatttcggtgagtcatatccgcactgctatgagttcttcagagttttgatgagcaaacactaaatcccaccaacaccgaaatattgcctgacttcaaaggcccagtgtgagagacggcctttgatgcagaacagagggcccgggtagacacaccaaatgagcccaagcacccttctaactagaagaataccaaaaatgctaagaatgccctgccttggcagagctcgccagaaaaggaggagggagaaggccggacgaaaaccaagccttatctcagtattccggaaacttttgagcaggaatggtttctttcttttttatcagaactttttaaaattagaagagcttttttaaggcatgtcatgaaatgcatttggtgctggtggtggtttagttgctaagtcatgtccgactcctgcgatcccatggagtgtagtatttagtagtccccatttgtctggtttttaagatccattgattaaaggtatcagcctcggtataagccgaaaactcacccagagaaacacaacacccccatgtaagcctccagtggtttctgtccccagattaccggcaaatcgactcctggaatggagggacctgtgagtgtcacgttacatgcttggggttgccactgtatgctgctgcgtctctcggttccttgggaatgtcatggaggctggagtcgattttaactcactgacagtgagtcgacagtaactcactgtcactgaagagtgacatttctgggctctaaaaacaatgatactagtaacataattgctgcttttcttggagagctagaacttgtgtcagagctgagtcagagtgctcgatggtatcagaagagaaaaggtgtgggcagcctttgcagaaatgcgttgccaacatccgtgtgggtttggatgctttacccaggagcctgggtggaggtacaaccacccaggcttaaaggcggcacattctccctcctaattagaggtcgatgtgtgcgattcattcctctttaacgatacacagacacatatgcccatcagcagcggcctttcagagatgggtacggggagcgacaaaatcgagcagggccctgtgggactcctgggcatggaaggctttctggcccctgtttctggtttgcagggaatagactccagcctccatgatattccctgaactgcaaagggcagattagaacagctgctaatcagagaagagaggaaatgcggaaactagagaagagcagccaagaaacagtagtgcagccttgggggagggtcctggttccttctcaggggatacacagggcaacgtcttcgagctctttacagaactaaaatgcccaatgaatggaaggtgttcagctcagttcagttgctcagtcgtgtctgactctttgtgaccccatggactgcagcacaccaggccttcctgttcatcaccaactcccatagtttactcaaactcctgtccatggagttggtgatgccatccaaccctctcatcctctgtcgtccccttctcttccagccttcaatctttcccagcatcagggtcttttccaataagtcagttcttcatgtcacgcgagtgtatgttcctcagttctttgtctcgacacaacaaagatttggagcaacggacattaaagccctcggcgcgtcacagctctcaggtcttggactaaccatgctacagctcttaggcaaatcagtgttacagctccattttatttagaagatagcaggagaatccaagactcaaagagaagagagtggaggagtgcatggggagggatgagggggaaagagagagagagagagagagagagcgcgcgcacgtgggagagggagtcccagagaaagcgctttggctcctccttttatatgttttttcctccacctgggcctgccctatgcaaattgggcttagccaggagtgctgtttgttctgttggttctgcctgaagtcttcactgtggtcctcggaccttccttgtcttgtagccaccgccattttggactccttttccctattctacctacctaacattcgcatccagtggccaaaggattggagtttcagcttcaacatcagtccttccaatgaatattcagggttgatgtcctttaggattgactggttggatctccttgcagttcaagggactctcaagagtcttctccaatccttcagagcttttggaaggtgttagcattcttcattccagagaacaccacctgagccctaatcctatcagcaagctcacccttgacctactgctataaaactcctcaccaaatccccatgggttgggacatgcagttttctgaggcaacagcctgctgtgtccccctttccctggcaaagcaataaagctatcctttttctacttcacccaaaactctgcctctgagattcgattcagcaccagtgcacagaaaccaagctttcagcatcagtgctttgccctgataggaatatgttattattgacattatttacagctgccagtgcatgacaatattaacgtaaagacagccatttagcctcttttattgtgtttttaggggcttctccagtggtacagaatctgcctgcaatgcaggagactcaggagatgcaggtctgatccctgggttgggaagattccctggagaagggcatggcaacccactccagtattcttgcctggagaatcccatgggcagaggagcctggcaggctagagtctacagtgtcacagagtcagacacaactgaagcaactgagcacacacacgcacgctgtttttaagtcctcaacagacaatgcaccctgctattccctagggcagagcacacccccccacccccaatcatgggtatgtcactgccttgcagtcattcattatctttagcaagaattacttaaggccttccctggtggtccagtggttaagaatctgcctgccaatgcaggagacatgagtttgatccctggtccaggaagattccacgccatggggcaactaaatccgtgcaccaaaactatggtgcccatgctttacagcctgagagctgcaaccactgaaccaatgtgctgcagccactgaagcctggatgctctagatcccatggtcttccacaagggaagtcaccacagtgcgaagcccactcacctagagagtagtccctctcactgcaactggagaaaaccccacacagcaatgaagaccccatgcagtcaaaaatcaagtaaacatataaattaaaaaatttttaaagacttactttaatcttccccttgggataacagctgccagtccctgaactcaactccctgacaggtcctgtgctaagcattttacacacagcactatatttttattctttacagcagccctgcatagaaagtgtatcattatcatctttattttaccattgagttatagaggctcagaacacttccttccactgtccaagatcacagacagccccaaagcagacaagaacatgaaccccaaattcaaagacctgctgcaaccaaaaattctccaaagggatgagatttaaggacgaggtgaagcatggcacacaatcaaggaaagaagattccagtgaggactgctgataaaatactctccacacaacacacaaatgtgccctgatctgtagcctcagccaatctccctggtataaacactttcatcagggtggctgtcactgcacacaggtaaggacgggccgagacgggtgagctggcccccatggtaaggctggctccatgcgccctgggctcagcggtggggcctttggacactcagagtgttatgcagggactggaactggggccatggagaagagcctctggaggtgagtgctgcagaaaaagagggaggagggtgtggggacaacctcactgccaacactgtttcataacagctcataggaactccagcaaacttcagtgccccaggtcaccaatgtccatccaggtcacacaagatgctctggtctgaacccttgtgtccccctaaaatccccttgctgaaatcctaatgcccatgtgattaggaagtgggattaggcatcaggaggtggggcctttggaaggtgcttaggtcatgagggtgcaccctcatgattggggttagtgcccttacatacgggaccccagagagattccttgcccttctgccaagtgtggttagagtaaaaaggacagctgtctatgagaagcaggtcgtaagaagataccaagtctgcaccttgatcctggccttctcagcacccagaattgagaggaagaaatttctgttgattgcaagccacctcattcatggcattttgtgatagcaactcagatggactaagacacagggctcgcccctctagtctgttacacataaggcagccagagggggctttacaaccccatccaaggacactgcctgcttaaatgctgccctacaggaagactccgcctcctccctggccatcagggccctgaatcctgccccagctctctgcctggtgcttctttctgctccctccaggcccctgcacctccggctgcaggcttctctaaggagtgagcttcctgtgccctgacctgaccccagccaggagttcttcatcacttgctgggaaagtcttccctgaactgaggtcaatcgattcctcctttgagcttcctgcacagtatcaagggcacaggggtcttctttagatatttttttaagagagagggtgtttctggggaaaggagatgtttggcctagaatctaagacgcgatcaagtatggaaagatctcaataaatgttttctggatgacgggacaatggaaatcacccaagacagaacaaccatccatgaaccctctgccagacgtgagttctcttcataagcaggacctggccacacttgtgcacagcagtgcttagtgagggtctgatgaagtgaagtgggcggacaggcctcactgcccgctggagaaacagggctttggccctgcaccagctttcccggggcctgctgatctcacaagggccttttcacttctttcagatgctggtcatgcccagcctctaatcataagcagttttccaacagacagaaaatgcgagacactatctcgcagaagtgtcttggcagaagtggaaaagaaggcgaagcttaggcagacaagggtgtggccaagggtgtcatcttttttgggggtgggggagctcttttttttttttttttttttttttcggctgtgctgggactttgttagagcacgagggatctttagttgccgcatgcaggatctagttcccggatcagggactgatccccctgcactgggaacgcggagtcttaaccactggaccaccagggaagtccctggtgtggtcatctctgagatcaggcgcctctaagagcgtgggcatctagaaatgaatttcctgagtctactgagtgggggaggagttggtgagagttcctgggggtggcgtagactgttctgcaaagtctggacctacttgtgggagtctgtgattgtgtgtacttgcgagtaagtgtgtggctacgtgagtgacaatgcgtatgtgtataatatgggggtgatagtatgcatgtgtgagagtccagctgtgtgcactgtgagcgtgtgacagtgggggggcacatgtgagtgtgagtctgggtgtgtgtttgaatgaattactgcattgtggtggcagtgcagaattttccaaaatttcatccctgaccgttggctaaatgtctttgctagcacactgctgtctttccaacaagtttttcaagtattcccaggaacctgtaattacctacacttctctcaggccctccatgcctggaggtgtgacctcctcatggaacagcaattactttgggactgcaaccggttaaccacaaaactggtgtgcgttagaaaggggggaagtcagtggagaaaggtgcaagactcagcatggaagaggctggagacttccctggaggtccagtggttaacactccaagctcccagtgcaggaggcgcgggttcaatcgctggtcggggaactgagatctcacacgctgcatacaatggccggaaaaaaaaaaggacagaaaaggctgctcccaccaagccctcttctttctctcaggaaagatgctgctttaggatggcccactgaggatgagagtgggaggaagccagctcgtaaagatctgtcactgtgggctcaggcggtaattgtgccactggccaccccagaagaacaagccgccccgcagctgagggggtgggggagcctcataacaagccctcctctgaaaaggagaaccagctccccattttttgggaaaagcaattgcagtctcttgtcgcccagtacctttagcatcagtaccaccgagttttacaaactcggaaggagttttttaaaaactcaggggtgggcttccctggtggtccagtggctaagaatctggctgccaatgcaggggacacgggtttgatccctggtctgggaggatcccacatgtcgcacagtaacgaagcccaggtgccgtgactactgagcctgtgctctgacgccttcaagctgtaactactgagcctgggtgccacagctactgaagcctgagtgcccagaagcccgtgctccgcaacaagagaagccactgcaacgagaagccggcgccctgttcccctcaaccagagagagcctgcatgcagcaagaaaaagcctgcatgcagtaacgaagaccccagcacagccaaataactaaataaacaaaagaattaaaaagaagaaaactcaggggccaagaacctacacaggtgagtgtgcacacacacgaggctgggaccccggcatgtctattaataagcgttccgaagctggacggatgccaactggtccaccggcggagcattttcatcaggctatgaatgaaactgggagcccacacccccacgcgctctgccccccttggcagttacttactaggttggcatttaaaggagaccaggaggtatttactgcttcctggacaaaggtcaggtccaaaaacacggctattgaccaggaggtggcaggcccgctggttctgacactcgtccagcaccttctaaaaggagaggtagaaaagggacaggcttgagaaccacatgcagcgtctgcgggaccccacgcctgggctgctctggagggacgggcccctgcctgcctggcctggggctcccatttaaagtctaagtctgagcctaagtctaagtctaagacagaagcacctacacggggctgatcggatcggccccggtctgcccatcacgcctcacaaaaaaatatctgctccaacagcaccaggcctcccacagaaaaccagtctccaattagccttgcctggcaccactactgaagttctggcaagagtgacatcgtggaggctcctggggacataagctatatcaaggtaccacagagggtggactggaagaaacgcagatgcccacccctacccaccacggctgtgcgaaacagtcacagctacgcatccttagaaacccccaacacaggtcacaggaaccgttagcgtttggaagactcctgggcttccccggtgactcagatggtaaaagaatccacctgcaaggcaggagacccgggttcaatccctgggttgggaagatcccctggggaagggaatggctaactactccagtattcttgcctggagaatcccatggacagaggactctggagggccacagtccatgggataacaaagagacagacacaactgagcaactaacactttcattttcagtttttggaaaccccgacccaaatgcaggtcaacacatgaaaattaaaaagttgatccttaccctcaccaaccgcaaggacacaggacccacccacttctgagcggtatcccatccagcggaacactcagactttctgttgagcctctggctttaaacactttccttcaagcctctcctgacctttcccaggctgatcacacctttgtgaatgagtctgctctgggcaagctcggggaccacccaccactgggttgcaagtaggcctccatcccactgctgccctcccagttcccacatgggtcaggaccccccccccccatcatgaacacagaggtcctccacaccaagaataggaaaaacgctcctaagaatctacttattcctgttggactgaatttagtgccaattcacaagcctgtctggagtcaccgtgttctcacagtcgcccatggaatatctcgtgaaggatgctggccctaccaggtattctctgtcaccttaggggcctcacagttgtgcataaaatcaggaaaaatgcccagggaaatccccaaggacccccaaaagatggagcatattccttggccgagggaatcatcagccgttgcatagctccttgtgttacaaccacgggacccaaggcagcgatctttccaaagtgtgtcagagctgagaggtgcagggaggggacttcctatagccatttagtctcgggatgaggtaggatgggaaggtgtcaccccgttccctcctacgttgggcaaccgccctctgaggaagcccctgcatcagctctcaaaacacaggttaaaagaggaaagaatctcttaacctctggaggaaaaagagcagcacgcagggatgcttctggcagacgagccctctgaacaacatccggactgtgtttacaaatgctgagtcgtccgcctggttacgggaacatcctcttccctcggggttgcctggcagaggcaggcgcccagatcagaggatgaggttggtgcctgcgtgtgccaggagttcatacctccccaaagtaggcacttccgccttggtggcactggtcactgttctttgaaagcccagggaaaagcctggcaccaggcaggtgggcatgggctgctggacttaggaatagggacattttcagggtacggggaagggctggagggaaggtggggcatgcaaggaaaggaaatgcttatctccagaagaaacatgttgtctctcctcagggcatggaaaccaggggattcattcaaacacatttatgtggtttcttggtgggtgtcttcaccaatcatgtgaccacccagatactacagtgcttggcatgaagcaataaatagtccaggcaacagaaaaaaccttacgttatcacattaggtttgtttctcctcttccagccttagggagagctgttccgtgttgaagctgattctatttctccccaatccttttcggaaatttaccgttactctcatttctcacaacagacaaaaatcaagctgacatctaattcaccagctactctaaccgccttgacatcaacagattcatagggaacttcggaggcattaaaaaaaaaaaaaaaacaactgactgcataaccttggccaactagttatagatgttgagggggccaggaaagctggatggaggttgtttgggtaactgaaagcaagaatagttgaaagtcatcatggatactggggttggccagaagagttctttcaggttttttgtgcgctgctacagaatgcattagttttgacctcctcgtagaccaagtgtttccccaatgccaatcgaaaaaagaatgagtcagctccgcacctccacccccaattcctggtactatcaagagtaaaccagcagagactggtcaacagagatccaaacagttaaccagcagagactgttcaacagagatccaaaccagaataacatgattatctacaactggagaagcaaaccctaaaaaatagcaaagataattattgatattcctcttccttgagtgcattctctaagaatctgaccatgacctctgatgtctgccttgcagtttctactaaagcaggcatggcctttccttgtctcctgggggtggggtggggggtggaggggctgatgagagatgttaagtctcgaggttgaaacccagcataatggtatgacttagctttaatgcagggagcagcgtgccttttaataaattcattctgcaagtgtatcacgggagggctccaataagtaggcattctatacagactcagaagcaaagactagctcatttgccaaattcgtgatctgtctacacggagattttcagggatcaggcttgcttggagtgaactgtggaatcacaagtatatacacagagagagggacagagaggcagaggcagagagatagaaaaccattttgtcatcttagaacatcttaggaaaggcaatacctgcagtgtggtgggcaccacacaggttaggctgtcttccctctgggaggcaggctgctgcggactacacttttggtaatcttgcccataaaatgccgactggacacttatcgtggaatgccgaggacactgcagattcaaatggtccccgtcacaggcataggcggtgtggttttgcaggagtttggttaggtaacctggaaaatattcagctgggttacaaggggtgtaggacttcaccactccttcatggatttcggagcgggaggacctcagctccccttgggcgggggctgggcagtgcagaaggtgtgggcggggcttcatccgctgtgggcggggcttcctcccttgctccctgggacaggacatcagacagagctgggggccgaaagggagcagatgctggcttttctgtctgggctggagcccttggtctgggctggcccgtggcaaggctccgagagcgtgttccctccaggaagcactgaagggctggccaggaggcaagaagtcctgaagcatctctataacgtaggaagagggagacttggcttctctgatctcccactagctgggccaggccttcctggaccgagaggatgcccattttattttagaaaaccagtcctgggcctgcctctgtcctggagaagaaaccaaggcaggcatcctgcctagggtaagggacttctctgaagggaggggagaggggatggtagggctccgttatgggtccagcagtgtcttcccccaaattgaccttcaccaggaacctcagaatgtgaccttatttggacacagggtcatggcagatgtaattaagtgaagctgagatcaggagtgagaaggtccctgaatcctatatgactggtttcctgacgagaagagagggagacacggggcagcaatcatgtaaagactacagtgatgtctctgcaagccaagaacctccagggtggtcaggagccaatgggagctggaagacagtaggaaagattcttttttttagttaaaatatatgtgtgtgtgtgtgtgtgtgtgtgtgtggctgtgctgcacagtctgtgggatcttagttccctgaccagggatcgaacctgtgtcacctgcaatggaagctcagagtcttaacccctgggccaccagggaagtcccaggaaagattcttcctgagaaactttgaagacagcacgaccctgctgacacctgatctagacttctgacttccagaactatgagagaatgtatttctacggttttcagtcatctgagttcacagtcatttgttacagcagccccaggagacttataccggctccctgtcactgcacctccagcgaggctggctgggtcgaaaaggccttgggctcggaggagctgtggacggcctggcaggcaccagcagcctggacgttttctcagaaaggaggaaggaaggttcatctgagatgcagattcctttcctccttctcacacctcatgaggtcaatcgcgaggcagctgggagggaagccagggactttctggggaggtgtgtgggagacggtgtggcagcgtcagccttcaaggggaggaggggtgtggaggaaggcagcctccaagcgccccagtccccgcagggatgggccgtgcttgagctattcctgctttggtttcaaaatcctctctgaaccgtcatgattgacaaaaggcgcccagtccagctccctgggctcccctgatggtcgctgagaagggactcagatgctcgaccctaggtggggctcacctgccaaagcacacctgcccagtgtgaaagcgaagactgggcgccctcaccagcactctgcatccagaccttaggtgtccggctgtaattacttttttccttcccacccacgaccaccatcataagaccggccaaggaatcagccaccccgaattaacttcacttagagaagtaaagtctagctttgagcagcaaaaaggcctgtgaatcggggcttcccaggtgacattagtggtaaagaacccacttgccaatgcagtagatgtaagagatgtgggtttgacccctgggtcaggaagatcctctggagaagggcacggcaacccactccagtatctttgtctggagaatcccatggacagaggagcctagtgggctgcggtccataggatcacaaagagttggacatgactgaagtgacttagcatgcatgcatgcattgtgagtcaggatcctgtttgttggaatgttgttacttataaggtgaacccctcggggcaccgagagggaccaggcagagatcccttggtggtcctggggccccaggtcagggtcatcctgtagggtgcacaggtgggccctgatgacgccatgatttatgcaagattctctgtggggtcttaggatccagggagctcagggtggctctgaggctgcctgcaggccggtacccaccctgaagcttcccagggttgtactctcatccttggatcccctcagctttgtcaataaaatgttcttgtccatcataccctgtccttcatggggatgctcagctggctgaaagcttaaatcagttctgggagcatgacctcagcttagtgtttatggtctgttcgaaaggccatttactctggctaaatgatgttaaggccctgggacagatggagccacaagaccaaaggggcctgattcccagactgatgaagtgaattgctgcctgctgcacagactgtcacgtgagtgagaaagaaacttctgctgtgtttggactatcacctttcatcacccagtttgtcatgtgttagtagtttgtcttcaggaaacaaacttgatctccgtgggactgtttgcatcaaaatacagccggatgcacagcaatggccagagcctccctgctaccatcttcatatcctgagagtgatgttctggagacagaagctcgatgcacagaattgattaactggaggtctttccggcccttttgcactttgaggagagaggggagcctccttcccgatacatcagttctgacactctacaagctcagcagtaaaacttgctctagactcagtctaattccttcttcggaaacctaggcctaagtccagcaatggaatattattcattccttggactgcaaggagatcaaaccagtcaatcctaaaggaaagcatccctgaatattcattggaaggactgacactgaagctgaagctccaatactttggccacctgatgtgaagatcgactcattggaaaagaccctgatgctggaaacgactgagggcaggaggagagtgcggcagacaatgagatggttggatggcatcactgattcaatgcacataagcttgagcaaactctgggagatagtggaggacagaggagtttggtgtgctgcagtctttggggtcaccaagaatcagacatgacgtagtgacttaacaacaacaacaaatgaaatgagctatgaagccacaaaagacatggaggaaacaagaggtatatgattaggtgaaagaagccaatttggaaaggctccatatcgcatgattccaactatatggtattcaggaaaaggtgaaactgtggagacagtgaaaatataagtggttgccagaggtttgcaggggagagagggatgaataggtggagcacagagggagtgtagggcaatgaaaccatcaaaggtgtcaccgcgtcaagagagaagctcggtatgaactatggactctgggtggcaatctggtgtcaccgcaggttccctggctgtgacagtacaccgctggtgtgggctgtgtgggatagtgggggaagctgtgggtgaaatccctgagctttgtgctcaatttcgctgtgaacctaaaccttctcagaaagaaagtctatttaaaaggggaaaaaaatctggacttccttggtggtgcactggttaagactctgcccttccaatgcagggggaacaggtttgagcccaggtcagggaagtgagatcccacatgccgttcggtgtggtcaaaagaatttttaaaactttaaaataagataatataaaacatttgtatgcagttaaaaaaaaaaaaaggaaaaagtttaaaaaccacccatgcatccccaggctagcatgaccttagggaagagagggttaggtgacagggaggggacatgagggggagtgtatgtgagctgccaaagctccttctcgacttgaagggcggctacgcatttcactgtgtctaagttcactggctgcgcacttaggatctgtgcaaatttttgttggtagataaatgtttgtttaaaaaacctttacctgcagctttgtgaccaatactttacactaataaagaaagtctaggaaaagcccttaaaactggcctctgcctctaactctgcttgttgttgtttagtcgctaagtcgtcccactctttgcgaccccatggactgcagcccaccaggctcctctgtccatggaattttccaggcaagaatactggaatgggccaccatttccttctccaggggatcttcctgccccagggattgattgaacccacatctcctgcactggcaggcagactctttgcctctgagccacctgggaaacccagctctgtgcttaccatgatgcaaacctgtagtctgtaatttgagactctgcatgacattatccacctgaaaggagaaccctgagctgatggtctaacagttcttgagtcagagattcccttatgaaagttaataaatggaagtctaggaaacgcttatcagcctgcccacattagggcccccagaggtgctttctatgccccattctgattggctgtgttagaaactgctaagagatcaaaagaaggacagttagaactacccctgctttcagcaacatgggggtcatcaaggaccacttggaggggcatctgggatggtgagtgggtaacgggagcctgtttagaaaaggttgaatgtgagcagaagttaagaaaatgggaacttccccggtggtccagtggttaagaatctgccctgcaacgcagaagacgtgggttcaatccctggttggagaactaagatcctacatgccacagtgcaactaactccaggcaccacaactactgagcccacaagccgcaaccagagaatccgtaggccacaaccaaagatcctgcgtgctacaaccaagaccccacacagacaaagaaatgaataaaaaatatgcagatggctcacctggtagacagaagaatcccccgcaaatgtccacagggaccagtccccagaatctataaatatattactttacatcacaaaagggattttgcagttatgattaatttaaagatcttgagatggcaagacaccttggatgatctaggagacaccaatgtaattccaaggtccttataagatggaggcaggaagatcagagtcagaggaaggaggagtagccacagaactagaggttggaacggagcagccatgagccaaaaatgcaggcagtatctagaaattgggaaagataaggaaacagatggtaccctgaattcccccaaaagaacgcagctttgccaacaccttgattttagacttctgacctccagaactgtaagagaatatgtttatgctgggtgaacatgagagcagccataggaaactaagagtttgtacagatgacccttataatgacttggtgaagatgaggagagaaataaggcttagtcataagaactgatgaccagggagagatttttcaataattacaactggattgaggttgggagagaatctatgtatgtacacgtatgtgtgtataaatacaaaggtacaggagtccgaggtcatgtttaaattacatttctcactgtgggttaggatcagacaaatttgaaaggggatgttagcaagagagagcttgaaatgatgaactgtgggctccaagctaaatataggtaaggtgggacttctctggaggtccaatggttaagaatctgtctgccaatgcaggggacatgggttcgatccctggtccgggaagatcgcacatgctgcgggtcaacaaagcccatgtgctggaactcctgaaatccgagcacctggagcctgtgttctgcaacaagagaggtcaccacaataggaagctgagagaagcccccactcaccacaactcgagaaaagcccgcttggaacagtgaagatccagtgcagccagaaataaatcaataagtacattttaaagaaataaacaaataaatacagggaaagagacagttgcaggagaggaccaggggaacagaggtctgctgagatccacagtgtcagtgggggcagtcataccagcaagctggagatggaggaccccatggcccaaagttgcttgatcagatttcaaggtggagcagttacaagtgatggaaatggccgtggtggagggtgtaagaagtcagtgtaggaagaggttcttgggaaagaggaccccaggagctgggaagatgccctctggatcagacatctcacagcataaaggtaggaactgtggaggagcaagagtccactgccgaggctgaccttgaacgaagtgcagagaacagatgacctgctcccaatctaaagccccttccagcgtgcaatcaccttccccactgagcatgcccactctttccagtgtgttgggctgagtcagcacattactgagtaccttacttcattcaggatgggcctccagggtggccctaggtatataaaggacccacctaccaatgtaggagatgcaggttcgatctctgggttgggaagatcccttagaggaagaaatggcaacccactccagcattctagcctggagaatccccatggacagaggagactggctgggcccatagggtcacaaagagtaagacatgactgaagcgacttagcacgcatgccattcaggatgcattaatgaaacccacagacagggtggcttatgagcaatggaattcatttctcacagttctgggggctggaagtccaaggtcaagggaccaacacggtcatgttctggtgagagccctcttcctgcttcacagatggcctcttctcactgtggaagagccaggggaattctatgggtctcttccgtaagagattcatgtgattagtgaatcccattcacaaaggctgggaaagattgaaagcaaaaggagaaaagggcggcagaggacgagatggttggatagtgtcaccacctcaatggacataaactttggcaaagtctgggagacagtgagggacagggaggcctggcatgctgcagtccatgtggtcctaaagagtcagacacacttagccactaaacgaccattcatgaaggctccgccctcatgacttaagctccacccttggccccacctcttaatacggtccctttcggagttaggatttcaatactgttgggttgggggtggaggtgggggcagggggctggggaatacacacacatttagaccgtagcacttagcttcccccatgcctcggtttcttggctgggatcctttaaaaataattaatacaacaatctaattttaatttcttttctttttttttttttgccccgccacatggcatgtgggatattagttttctgacgagggatcaaatccgtgccccctgaattagaagcacagagttttaaccactggactgccagggaagtccctagatgggatcctttttaaagatgcagcttttgttaagatttctctctggatcaaatgccccatcacgttgggtcagtcaaaaacgctttgtgtgttaatactctcagccagtgttttcactgtcttgcctatttgtgggcaaatatttactattctgaaagaaggcaaaagtgcacactctgttaagaaatcactcctcagaatctggaatggcctggaaatgctccatcgacccttgtttaaactggaggagagggagcagtgggaaggtgtccgctctcttccctggtgaaccctccagtgtgtatcagcagaaattcctacagccccagccacggctcgcaccttccacaaaggcacatccaaagaggcttcagctgggcaaatcttagaggcctttagataaaggctttgatgttttcctgtttctaaaggtgagtgagaggttcatgggaaagaactcctaagaggaacagaagctcttctccatcttcagaacgaccctgggaagacattcttggaatcatcatgcccagtgcatttccaaggaaaaaacccatttatacacaaataatccagggagccctgaaggaccaaagaatcagggagccagggtgggtggggtggtatggggagtggggagacaatgtgttctacggaaggagcaggtgttatgctggggggaaaggaaggtctatccaaattaaggcttcccgggtggtgcagtggtaaagaacccacctgccaatgcaggagacgcaggagacgcaggttcgatccctgggtcaggaagattccctggagaaggaaatggcaacccactccagtattcctgcctgggaaatcccatggacagaggagcctggtggactgcattgcatgggactgcaagagttagacacaactgagcgagcacgcacccaaaattaatcttggaacatacacgttaaaccaaggcaaactgttcttgcccttcaggacttctccgaatcacagagacccctctgtgcactaggatgtgaggacggacatacaggtggactctcacccacatatttgaccagtccctcccgttagcatctgagggttactgttaagcgcatcattctgaagggaatatgcactgcgtctgtagtggtcagagctacatggtcagagctaagaggtgcatccaacttggatggtttcagaaggcatttcagaatcccatacagctggagcatcctcatcctgaagcagggggatggacagggaggaagtgggaggaacacagaggattaaaagccccgaggccagggttcaacctgggattacggtgtgtgactgtgaccatcacctctcagaattggtggggactgtatcttccatcacccacaaaccactgcctgacactaaagtattgctatcataaagtaaatcttgttaagatttttttctgtgtttgtgtagaccattttttaatcctttattgaatctgctacaatattgaatctgttacaatattgtctctgttttacatttcggctctttggccacaggacatatgggctctcaggaatccaaccaggggtcgaaaccacacccccggcagcagaaggcgaagtcctaaccactggaccaccaggggagtgagtccctcccacatggtcaatgttgaagaacatggatttactcagcgctctcattgattcaacgcaaatcacaagcctagccagccctctctgctctgagccccagtggttggatggtcaactcaaaaacaagcacacagccccaggagcagccatcacgcaatgtccagaaatgtcagcagtgtcacttgctgagctcagaaagaaaagaaaattttcctcacttctttccttcccctctttccttcttgttctttctcttttttacttcttttaaataaataaggtttaagaagccactaatatttagtggctcagtggtaaagaatccttctgccgatgcaggagactcgggtccaaccctgggtcaggaagatcccctggaggaggaaatgacaacccactccaggattcttgcctgggaaatcccatggacagaggagcctggcgggctacagtccatggggtcgcaaagattcagacacgacttagtgactgagaacacacagtatttagaagagactaaacatgctccagattcttcctctttttttcccccttgaagccagaagccctccactaaagttcaagtttcccaagggctgaggttgcctgagtcagtccaagctcaggatgtaaatacatccctctctggctgcacatccgtgtgctcaagtcccctaatcaccaggggccaatttcacaaccttacttctgggaagagaacggaattcaattgtattgtccctgttcttcccacccctcattttcttacaataaagcagcaccctgcagtcccttaatgctttagataagagactacaccctttcattcacaaatactcaaaggtgtttctacacgtttgaagttcttttccagaaaagggtatttttttttcttttctgtaggcaagggtgtttagagaattggctggagcaggagaagggggcagcccacgcggctttagagcaatgagtcagtgagtctgaggacgcagcaaaggcccccagtggataaagggctcagggctgggcaccgcacccccaagagcattaagatcaaaaagcgagtttagcctttaagtctcttcttcagtgccaggtttggctcaaaaaaagttgactctggagtttaattaggagaactagagatcggacgtctcctagatgtctgagagggaatcacaaagacagggacgaccgaggtagctatgctgctcttaagtcaggcactcagatcctggtcccaaaacaaaacagcggagcacagaggtgaagtgagagtctaggcagggcagagacaatacagttcttcccgagcaccggggagaagcaggttttccaggtctcctgacaatacagtgggccagtggaagttcccgctaatagcaagagggcagaaatgatgctggcgacttgacggcggggcgctggagagggcggggcgctggagagggcgcatgtgaccctctactccctctgtctcgtctgccgtcacacgtggaagacaaagcagacaaggacagggacctccctggtggtccggtgcttaagaatccactttccaatgcaggggacacgagttcgattcttggttagggaattaagatcccacatgctgcggagcaactaagcccacgtgccacaaccaccgaggcttccagatgcaacgagtgagcccgcatgacgcaaggaagatcctgagtgccacgactgaggcccagcacagacaaataaagaaacaaatgcttaaaaaaaaagtttaaaaagagagagacaaggacaagctccgaagacccagaagatggggaaagcccaagacagaaggaaccggatgcctgaatgaccccatggagcacagcctccccgcttgtccagtcccactagaccgtggcatgagcaggaaagagggctttatcctctttatcccagcaagatctggcagttgtgttgtgggtttcagcggctaacctaccctgactaatgctctggcattctgtcacctgggacttgtgttaagtaggaagctgctaagtctttgaggagtataccaaaagttttagcgtttcagtgtttatctcattgatttgtgatcgtgctgttgacaacattccacatgactttcaatcctcatttaggggaatcattgagctaagggcttccctggtggctcagacaggaaaaaacctgcccgcagtgcgggagacctgggttcaatccctgggtcgggaagatcccctgaagaagggaatggctacccactccggtgttcttgcctggagaattctatggacagagaagagtttgggctacagtccatgaggttgcaaagcgtcagacacaactgagcggatagcactttctttgagctaagaccttgctatcattgaagtgagttaaaggataaaacgcactgcgtgctgtgcttagttgccctgtcgtgtccgactctttgcagccccaggcacagcagcccaccaggctcctctgtccaagggattctccaggcaagaatactgaatgggttgccatttccttctccaggggatcttcccgacccagggatcgaacctgtgtctcttgcattggcaggcggattctttaccgctgtgccacctgggaagccccagaattaaattactaaggagataaaaaggattagaggtctcattgattagccaactaatcaccactcttcacaatgccactgactttttgaaactttaaaaaaaaactttcagcaaaaatgtgaggcagagactaagtgggcttttatggaacgctcattaagcaggcaagcttcccggtgctggtgagtgtgggaagcagatgggactgtgggcagagtgctgtggtgccccagagagtgctggccctggataaagtgccaaaacacagatgtggaggccacaggctgggaggtagggaattcgggctctgagaccccttaggtccggtgtttttcaggcatgttaaacctaactcctttacatctcagtttctcatctgtaatacagtgatggacagggaagtctggcgtgcagtccatggggtcacaaagagtcggacacgactgagggactgaactgaattgatatgtactttatgggcttcccaggtggcgctagtggtaaagaatctgcctgccagtgcaggttagacataaaagggttcgatccctaggtcagaaagatcccctggaggagggcatggcaacccgctccagtattcttgcctggagaatcccatggacagaggagcctcgtgggctataatccatagggttgcacagagtcagacacgactgaagcgacttggcacggcaagagcagcttgcacagtgactgggcatgccagtttcattccctgaggacagcatgagtgtacaaggaagaaaaaactggaagcccaatctctatggaacagggagccccaaaacaggcaaggacaagcagcccgaaatctgctgcttccaagcttagccttggtttggatttaagtttaagacatctggtagcagagtagatgatgcctgttttcacattctataaaactgcccaagaacagacccatattcatgatgagggttataccattaatcatttgtccccaggtttgagggtgccatggaagctttttgtatacacacaagcacaacactttaaaaaagaactggctgagtgctaatttggaaatgtctgctggcttctgatatattcgtttgaacctacaaatttagaaaatccagttttctaccacttttttccagcaaactcaaaccattacattctctttgacaataaagctacttgattttcttcagttcagttcagttcagtcgctcagttgtgttcgactctttgcgaccccatggactgcagcacgccagacttccctgtccatcaccaactcccggagcttgctcaaactcatgtccattgagtcggtgatgccatccaaccatctcatcctctgttgtccccttctcctcctgccttcaatcttcaatgcttgattttcttaaaaccaaataaaaatatgaattttttaaaaagttttattttttgatggctgtgctgggtcttcactgctgtacgtgggcttttctctactgtggggagcacggactactctctagtactggtgagtgggcttctcatcgcagtagcttctcttattgcagagactctggagcacaggctcagtggttgtgacacagaggcttagctgctctgaggcatgtgagatcttaccagagcagggatcgaacccatgtctcctgcagtggtaggcggattctttaccactgagccaccaggaaagtcaaaaaataaagactatttctaaaggcacataacctacaaaattttccatgcttgtcattgtttcaagagcatataaagaaaccccaaagtgtacgtgattaaaaatattctcaaattttgatcaataataatggagaagatggaaatgagttgctaacgtttgacaagaaaagtgacagcccccagctctctgtgacttttccaccctgaggaatgaacactttttcattttccacgactgccacatggcacccagcttccatttacccacttcccctgggctttgaattctcgtatttaattctggtttccagcactcactcattcaatgatctcttattttgttagtttttctccctacatctccttttctctctgctcactggccctctgattcaccaaacctcgtactatccccatgtatattcatacatacgaagtgggtttttctgtgtgaagcccagctgtgtatttatacatatggatcaggtccttatgcctaagcatttgtcttcatatgtcaatccattctatggctttcaactccactcaaacaaaaaaatccaaagcccttgtgagatggaggcccccctccactgcctacctggcttcatcctttggctgtgccaggtcttcgctgtggcacatgggctctttagctgtgacatgtaaactcttagttgcagcatgtggaatctagttccctgaccagggatcgaaccctggcctcctgaattggtagcatgagtcttagctgttgaaccaccagggacgtccctgaacctcatccttataactctccccctcagctctggccaccgtggtcttcttgtttctcagaactgtacactcccacctcaggacctttgctttggctattctgttcaccagaaagcttcttccttcctacatctgctttccccctccctcccttcatcctgccctctgtgcaaaggtaaccttatcagacaggcttccctgggtgctctgagaggcaggcactacctgcccctccagccttgattctgccgccttccactacatgcagacatgctgtcagtttcgccccgtctacatgtaagtgggaacattgttttattaattgctgtattcccagaacctagaaagagtctgacatatagtccgaaggcaatggatagtttttaaatgagtgggtgagtaagcccagcagagcaagaccagaggagaatgcctgagtagtatattctgattaatcctcacagcgctgatatcacccagtcctcatagatcttgctacgtaattgtgatggcaattttgaagatctatattcctaatggaatgggcctcaacaagcccacaaacaggctgtgagcatcccatccaggcaaccaggtgcactggagtgataagaccagtccctaccacatgctctcctgagtttgacctcagttcagttcagttcaatcactcagtcgtatccgactctttgcgacctcatggactgcagcacgccaggcctccctgtccatcaccaactcctggagtttactcaagctcatgtccattgagtcggtgatgccatccaaccatctcatcctctgtcgtccccttctcctcccaccttcaatctttcccagcatcagggtcttttcaaatgagtcagctcttcacatcaggtggccaaagtattggagtttcagcttcaacatcagtccttccaatgaatattcaggactggtttccttgatgatggactagttggatctccttgcagtccaagggactctcaagagtcttctccaacaccacagttcaaaagcatcaattcttcggtgctcagctttctttatagtccaactctcacatccatacgtgaccactggaaaaaccatagctttgaagacagacctttattggtaaagtagagcccctgctttttaatatgctgtctaggttggtcatagcttttcttccaaggagcaaaagtattttaatttcatggctacagtcaccatctacagtgattttggaccccaaaaagataaagtctgtcaccgttgccactgtttccccatctatttgccatgaagtgttgacctagtgtcattcaaacacaccaacaaaaccctttgcggcttttgttatgtactcccccttgacctccaatgaagacccttgcccacaggtcctctctctctgtcaactcccacctgcttggctgagctgttccctggatgctcctcccacatggcccctgcgcagtgtaccacgtgtgtgtgctgtactacgtgtgtgtgctgtgtgctcagctgtatctaactctttcacaaccccgtggactacagcccaccatagcccaccaggctcctctgtccatgggattttccaggcaagaatcctgggatgggttgccattttctactccaggggatcttcccaacccagggattgaacccaagcctcctgcattagcaggcggattctttaccactaagccacctgggaagccccgtggtgtactatgccttcctcctatgggacccttacgtgtaaccgatcctttagcttcaagtaatttccatggctatgttggtttgatgcttataaagcccagaaggaggactttctccaccatttatgacacaataaaaatttatatatatacatatatgcttatactgggcttccctgatagctcagtgggtaaagaatctgtctgcaatacaggagaccccagttcaattcctgggtcaggaagctcccctggagaaggaataggctacccactccagtgttcttgggcttcccttgtggctcagaatgtacagaatcctcctgcaatgcaagaaacctgggtctgatcactgggttggaaaatcccctggaggagggcatggaaagccactccagtattcttgcttagagaatcctcatggacagaggagcctggctggctccagtccatgggtcacaaagagtcggacatgactgagagattaagcatagcacagcagatgcatatattatgggtttcacagatggctcactggttaagaatccgactgccaagcaggagacacagggtcaacccgtgggtcgggaagatcccctggagaaggaaatggcaacccactgcagtattcttgcctggcaattcccatgggcagaggagtctggcaggctacagtccatgtggtcacagaagagtcggacacaactgagcgattaaaccagaacaccatacatacgttatacgtctgtgcctatggatatacacatatacagacagagaaagacaggaatcaactgattacaaattgctctgaatgggctgtgtcatacttgaattacagttgtacggcaacactcagtattttacttttgaacaatctgcaggagcctcgctgtgcctttctaaccaaagatttcacctcctacaaaaacgaacactttattcaataaccaggtacccagcccagaaaggtattcagccaacaccatctggatttgagttgtttcaaagtaactggatcaatccccatttgcccaaagcatttacacggaaagctttttcttttctttgggatgcagagtaactcccaaattacagagccacttggcgattaaggcaggatggaggtgcatttgataacttaatgcaactttttaccagcacttaaaactcagatatgaaatctacacttgatctttcctgcttggaattggccaaattagtggctgtatccccatgtacaacaaaagcctctcagaaacactcagggaagccgaccaaccaaagggcccaacacagtccaacgcaagcatgtgggggcgggccggtgccgcctccgcctcgagcccctcaaacagcctttcggctccagacggttatgtgtaggatgatcaagggtagacgtgatacgctcaaggtagaaatgaggacttcagggcatgccttgcgagctttctccagttaattgcaaaattatatagtgatttcactgctcataacaataaaaccttctcttttaactttaaagatgatgatgactggtgagcagcactataaacctcagaaagttgtctagaaggttaaaatgactggactggatttaggggaagggcagatttgctgcactttttaaaaaaaccttttttattgtggtagaggtcatgtattataagacatactattataaccatatttaattgtacagttcagcggcaataggtatgttcacattattgtgcaaccatcaccgtcatccagctcctgaatttttcacctccttcaactgaaactctgtccccattaaacacttaactacccatgccccctccccacctccctccatcccacctccccactcaccagtcccggacatctacgaatgtactttctgactaccaatttgactattctagtgaaagtgttagtcactcagtcatgtccgactctttgcaaccccatggactacaacccgccaggctcccctgtccatgggattctccaggcaagaatacaggagtgggttgccatgccctcctccgggggatcttcccaactcagggattgaacccaggtctcccgcattgcaagtagagtctttactgtctgagccaccaaggaagtaactgtataagtggactgaagcagtatttgtctgcacctactgtatactggaatgcattctgaaggttaacaacaaaagttctacaaacagaaaatgaaagtgttacttgctcagcggtgtccgactctttgcgaccccatggactgtagccttccaggctcctctatccatgcgattctccagacaagtgggtagccagtcccttctccatggaatctttgtgacccagggattgaacctcagtctcctgcactgtgggcagattctttaccacctgagccatcgactgtacgttttctccccgccgtactatagagtaggctgtcaccagccatgattgaatatgttttgctcccttgacagttaacaaaaaagagcagagaagtttctaaaatctgtaacagatgtctccaagagtctgtccttagggagtccgcgggctgactgactgtatctattacagcctcctgatgggtttaacagaggatgtgggggcaggtcatttagtttcccccttatttggtttcaccccagtattaggggaagtagcggcattacttcctttgtatttttcagaaatgggcgaggctggcaaatgtaaagaaatacgggcgcccgcacgataatcaggctgatcgggccttaatcatgacattcatccttaattgagtccctggcacactctcccttggcataaacccccaatgggctcagcttcactcagtggccccagttcagttcagttgctcagtcgtgtccaactctttgcaatcccatgaaccacagcacgccaggcctccctgtccatcaccaactcccaaagtccacccaaacccatgtccattgtgtcggtgatgccatccaaacatctcatcctctgtcatccccttctcctccagccctcaatctttcccagcatcagggtcttttcaaatgagtcagctctccgcatcaggtggccaaagtattggagtttcagcttcaacatcagtccctccaatgaacacccagggctgatctcctttaggatggactggatggatctccttgcagtccaagggactctcaagagtcttctccaacaccacagttcaaaagcatcaattcttcggtgctcagctttctttatagtccaaatctcacatccatacacgactactggaaaaaccatagccttgaccagatggactttgttggcaaagtaatgtccctgctttttaatatgctgtctaggttggtcataactttctttccaaggagcaagcatcttttaatttcatggctgcaatcaccatttgcagtggttttggagcccaaaaaaataaagccagccactgtttccccatctatttcccatgaagtgatgagaccagatgccatgatcttagttttctgaatgttgagctttaagccaattttttcactctcctctttcacttttatcaagaggctctttatgtcatcacatttggaaaactcagcagtggccacaggactggaaaaggtcagttttcactccaatcctaaagaaaggcaatgccaaagaatgctcaaactaccacacaattgcactcatctcacacgctagtaaaaaaatgctcaaaattctccaagccaggcttcagcaatatgtgaaccgtgaacttggagatgttcaagctggtttttaaaaaggcagaggaaccagagatcaaattgccaacatcccctggatcatcaaaaaagcaagagagttccagaaaaacatctatttctgctttattgactatgccaaagcctttgacggtgtggatcacaataaactgtggaaaattctgaaagagatgggaataccagtggccccaaggactcacacttttcttcgttcttctacgagctccttatttactcttccataccattctcatacagcagtcatgtatggatgtgagagttgggctataaagaaagctgagcaccaaagaactgagatttttgaactgtggtgttagagaagactcttgagagtcccctggactgcaaagagatccaactagtccatcctaaaggaaatcagtcctgaaaattcattggcaggactgatgctgaagctgaagctccaatactttggccacctgatgtgaactgactcactggaaaagaccctgatgctgggaaagattgaaggtggaaggagaagagaacaacagaggatgagatgattggatggcatcactgacacaatggacatgagtttgagtacgctctgggagttggtgatggacagggaggcctggcgtactgcagtccatggggtcgcaaagagttggacacgactgagtgactgaacttggagaaggatatggcaccccactccagtactcccacctggaaaatcccatggatggaagagcctggtgggctgcagtccatggggtcaccaagagtaggacatgactgagcgacttcactttcatttttcactttcatgcattgaagaaggaaatggcaacccactccagtgttattgcctggagaattccagggacgggggagcctggtgggctgccatctatggggtcacacagagtcggacatgactgaagcgacttagcagcagcagcagcagcagagtgattgaactgaacccttctctggctgacacctgttacttctgacggccctcagctgacacttgctattctgagtctgttgccttcttttatacataaccatctgggtgacagttgagtacttacattacaccatgtctacttgattcaccaccacactggagtcttttttctactgattggctcctgaccaccttctggatggttaaatggaggaaaatctgaccctggttcactggtatataaagccaactctcaggtttgccaaccatgtttctgcaaactcagagactcactaacatgttatttgtaaacgtccaagacagttcccctgtgctgccccaccattcttgggaaagacttgagttaccgacttgcatgctcccagccaaagtggaaccagggggatgctctaccctctagtgtcagctcacaaaccacaaacacatgcaaagcacatggtctgtcttgttgaggttcagtcactaagtcatgtccagctccctgcaaccccatgaactgcagcatgtcaggcttccctgtccttcactatctgccagagtttgctcaagcttctgtccattgagtcactgatgccatccaaccatctcatcccctgttgcccccctctcctcttgccttcaatctttcccagcatcagggtcttttccaatgagtcagctcttcacatcaggtggccaaagtattagagcttcagtttcagcatcagtccttccgatgaatattcagggttgattttctttaggatagactggtttgatctccttgcagtccaagggactcacaagagtgttctccaacaccactccagtttgaaagcatttagcaccatgtttctcacatttttctgctttgtgatggtgattctgctgtgtcaaatagacccaagcatggtacagtgctgtatcatgttattaaatacaacaagctgacatgggcctcacaaagaaaatatttgggcttttctgtaagatgttacagaaatgaacttgttggccaacccaatacatcagttagaggggcttcatccaagcacgaagtacagtgctgctgggcgagttcaatgttaacgaaacaacaatatgttttaaataaggtgtctttaagcagaaacatgcataaaaccccctacaaacagtgtctcagtatttgctaatttcgtgctgtaaaacaggtcttaatagaatataccaccttgagaaaagggaatcctcttatactgtaggaggggattcttgcctagtaactgaatcggtaaggaatccgcctgcagtgtaggagaccaaggtttgatccctaaatggcaaccttgcctgaagaatcccatagacagaggagtctggtgggctacagtccatggggtcacaaagaatcagacaaaattagagttcagaaagatacgtgcaccactatgtctacagcagcactattcacaacagctaagatgttggactccaatatccgttgaatcatcgaaaaagcaagagagttccagaagaacatctacttctgctttattgactacgccaaagcctttgattgtggatcacaacaaactgtggaaaattcttaaagagatgagaataccagaccacctgatctgcttcttgagaaatctgtatgcaggtcaagaagcaacagttagaactggacatggaacaacaggctggttccaaattgggaaaggagtacatcaagtctgtatattgtcaccctgcttatttcacttatatgcagagtacatcatgcaaaatgctgggctggatgaagcacaagctggaatcaagatttccaggagaattaacaatgacctcagatatacagatgataccacccttatggcagaaagcaaagaagaactgaagagcctcttgatgaaagtgaaagaggtgagtgaaaaagttggcttaaaactttgaatgttgattcaaagaactaagatcatggcatctggtcccatcacttcatggccaatagatggggaaacaacagaagcagtgagagatgttattttattgggctccaatatcactgcagatggtgactgcagccatgaaattaaaagacacttgctccttggaagaaaaactatgaccaacttagacatcatattaaaaagcagacacattacttttccaacaatggtccatctagtcaaagctctgctttttccagtagtcatgtatggatgtgagagttggactataaagaaagctgaccactgaagaactgatgcttttgaactgtggtgttagagaagactcttgagagtgccgtagactgcaaggagatacaaccagtcaatcttaaaggaaatcagtcctgaatattcattggaaggactgatgctgaagctgaaactccaatactttggctagctgatgcgaagaacgggctcatttgaaaagaccctggtgctgggaaagatggaaggtgggaggagaaggggacgatagaggatgacatggttggatggcatcaacaactcagtggacatgagtttgagtaggctccgggagttggtgatggacagggaagcctggcgtgctacagttcgtggggtcgcaaagagtcagacacgactgagcgactgagctgaactgaactgaagatatggaaacaacagatgaatggataaagaagatgtggtataatgtgtgtgtgtgtgtatatatatatatatatatatatacacacacacaatgaaatattactcaatcattgataagaatgaaatatttgcaggaacatggatggacctagagactgtcatactgagtgaaataagtcagaaagagacagatagacaccagatgatatcacttatatgtagaatctaaaatatgacacaaatgaatctatctgtgaaacagaggatcagagacatagagaagagactggtcatcaccaaggggaaagagggggggagagagatgggttgggagtttgagataagcagatgcaaaccagtatattcagaatggataaacaacaaggtcctatagcacagcacgtggaactgtattcaatgtcctgtgataaaccataatggaaagtatatgacaaatatattgatatacatgtataactgaatcactttgctgtacagcagaaattaacataatattgtaaatcaaccatatttcaataaaaaatttaaaaattaaatagaacatattacttcaaataatgagaaccagtgtatttctatattagggacagagcactagcctttatacataattcaaacaggcagaactactttggggattgccttcagagcaagagctttgtctttgctgaacacccaggcggctcagtggtaaagaatccacctgccaatgcaggaaacacaggagactcagggtggatccctgggttggaaagaccccctggaggaggaaatggcaacccagtccagtattcttgcctgggaaatgccagggacagaggaacccggagggttacagtccatggaatcacaaagagtccgacacaacacagcgactaagcacacacacacatagggacctccttggtagtccagtggctgggagtctgccttccagtgtggaggacatgggttcaatccctggtcagggaactaagaccttacatgcctcagagctgttaagcccatgtgccacaacggaaaatccactgcacagcaaccagaacccaatgcagccaaaaacaaattaattaattaaaaaggtaaaattagtcatttctcctttttaaaatgaaatgttcaacctttaatgaaagccttgccatggagaagggaaagggtacccactccactattctggcgtggagaattccatggactgtatatatagtccatggggtcacaaagagtcggacatgactgagcaactttcacttcacttgccatgattatcctcatgacagctctctgatgtggagttgttcaggggagttgttcactttcgctgacacagcatatctcttggcccactggcggtgagatggagatgagtccccactccaactctcaacctgagtctctactccaggttcaagggcacttcacaacccctgccagaatccaagacatagaataaaggaggaatcactcacttctctatatctggtggtggtgatggtggtttagccgctaagtcgtgtctgactcttgagtgtccaactctgtccctgggattctccaggcaagaatactggagtgggttgccatttccttctcggtctcttatatacttggttataatattatgttcagagtgatttttttttaatttaaattttttgggcctcaccacacagcatctggtatcttagttcccaggccagggttcgaatccataccccttgtagtggaagcgtggagtcctaaccactggaccagggaaatcgcccagagtgattttaactgctgtggtagaggagcacagagagtgtctggtgggagggggtcagtaataaggaacatgtgacttacccaagaaggaagcaggaaggcttccggatgggaggtggtgcctgaagaaagcacagggggtagccaggtgaaaatgacctcaggcagcaggggccacatgtgcaggggctcaaaggaaacttctagacctttggcatggtcagtggacagggtatgaggtcaggagcgaaggctggagaagttagcagggcttccctaaggagtttgaagttaacctgaagtcagatgggagccattgaaggttgaagataggcaagtgatactggtcagatttgcaattccgagaaatcctgaatccagcagtccatgttggagggactggagagacccaggaagaaatctgggtgaccgccatcctatgtggtccaggatgaaggcctgacttaagacagtggcagggggacagggtcagagggatggagatcagagtctacaacaccagtgtgtgacctgagctggtgcacagagctagctccacactcagaagggccaggctcttggtttaacactctgctgtgaccaccttgacagtcttaataatttaatccttgaacatgtgttttgtaaatgaagcccagtgggacaagaggccatgagtgtgggcagaggagatgcccacagtcccttgccatcacaatgtcataaagtgtttgagatgtcctgagcagagaatgccacagaagtgaaactccaccagcacaactcagagtgagcatcgggaaagcatgttgcgtgtccagctgggtaggcagacacgctgacagcaccacgctctccctcagaacaggaatgtgctttgaatgagggaagctggctgggacatcgtagaaaatccggacaacccagaaacccagcatatcttcttattcttgttagtgccacgcattagccagatactcatgctgcaaatgatggcacagaaggaaagggaaagacagagattcccacagcttctgttcctttcaaccactgcttacatatcagtaagacaaagtagagagcagtatacacacaaacggacaggatatacacaaaacaagaatgcgtcatttctgtaattccatacacctattccatgttctcatatttgtatttaaaactagcgtcacctaatatgaagatgatgataaaatccatgctcctaatttaaagggtccactttttttcacttagaacaacattgaagagcaaataaacacagtgataagaaagctctgaatatcagtacgtttaaaacagctcctcctccttgatttctggacaaggagctcccgttttcactttgcactggggcctgccgattatgcagctggtggagactgaaatgacagtgatttagcactacaactggatggggacgcggtacatagaaacaagagagactaatggatccctcctgggttctgaaccggtggggccatgctcctgggaaattcagcatcgaaagtagggtctgtgattccgttctgagtgcctgtggggtgtcccagcagagtgtccggagtcagaagctccggagagggacctgggaggagggacaccaggaagcgatctgcaaacccgaggggacggctagtgtgagaactgcgggcagaggcactgggggcgcagaccttgaggagatgggaggacggagaagacccttgagaggagacgaagagggagggaagacaggaaggaaggaggaagaggcccagcgtggctgccaaggagatgcgagaagtaacacaacagccagaggcgagtatcacggggctgagcaaagcgggtgttaccagctctggggaccttgaggaaacggtccgacctctctgagcctcagatgtgcacctataaaatgaaggtaacagtaatgacacatctcagaggaccgttgtcaagattaactgagctattatgtgtgtagggctcagaactctcctgcattcatttctcatggcttctgtaacaaggtaccacagactggcggctgagaagaacagaaatgtattgcctcacagttctggaggccagaagtccaaaatcaaggggtggatggggccacactccctctgagagctccagggaaggctgtgttccaggcctctccctccccgcccctccccgctctggttgtttcctggcttgtggcaccataactctgatcctcacatggccttctcgccctgtgtctctgtgtccaaacctcccctgtttataagaacacttatcaaatattggctcttcacatcaggtggccaaagtattggagcttcagcttcagcaacagtccttccaatgaatattcagggttgatttcctttaggattgactggtttgatctccttgcagtccaccagactctcgagagtcttctccagcagcacagttcaaaagcaacaattcggtgctcagccatctttatgggccaattctcacatccatacagaggggaaagaaaacttataatcctaactgttggattagacatctttgtataacaacttcattacttctgtaaagacttaggtaaagattacttctgcaaagactctatctccaaataagggcacaggtaccacgtaaagactctagtatcttttcagaggggacatccagagtcagctgaggataaacatttatctttattatcattaccttgattagttgctgtttggttcaaaggtatgaggaagtgacccagggacaacgtgagtttggggaactcaaatttgttgtggccaccatctccatgacaacatgacgtttccccaacagcccaggtgaaggtaaacatatgaagtaaggagagagaacaaagaaaagggaatgacgcattctgataacgagccaaagacaagcatgagcagaaatcgcgacagcagctcaagagggaagctgcttgctgcccagtgaggcttggtataccagatggccagaaataaataccatcccttccctaactcagtcaataacacacagttccctacatgcacacagaaggaaaaccgagttttgatcatttattaaataacaggcttcgtctgtggaatcacaaggtcttctgagccagaagcaaaatggatgccttccaccaactgaagttctagtgttctttgaagtggtaagaaccacaactgatctggagataagcagtaattaataaacaggttgagttgccagaagtgtcaaactggtcaacatcttaataggaattatgtctggggctaaactggaagccatcaatctcaaaggaaaaaacagatggatctgtgaggtgcatcaaacctcagaaacagatagttgctctgttttagatggaggattgaaaaggaacattttagtcctcaccaaaggcacaggtaagcagaggctctcttccttgcctccctccctaatctgaagttccttccagaacaaatgctttcctgtcacttcatcccaacaccaggagcaatactggcagtgcctttcctggactagttccctttgccaaagctccaggttctagaacctttttcctttcccctctaaacagatgtgagagttcgatcataaagaaggctgagcactgaagaattgatgcttttgaactgtgacactagagtagaccctccagagtccctcagactgcaaggagatcaaaccagtcactcctaaggaaatcaaccccaaatattcattggaaggactgtggctgaagctgaagttctaatactttggccacctgatgctcagagcccattcattggaaaagaccctgatgctgggaaagactgaaggcaggaggagaagggggcaacagagaatgagatggttggatggcaccaccaactcagtggacatgagtttgagcaaactctgggagaaagtgcaagacagaggagcctggtgtgttacagtccatggggtcacaaagagttgggcatgactgagtaatggcacaacaacttctgctttaagacttgcttctcctgagttcaaggcccaaagaactttgctagacatattgctacctgccgtgattcaatctgtgtgaggacagctgatgatggcaactttcatctaaaaatcatcttcaccaaacattaaagccacttcagagtaacagggttaccaatatcctattcctcaccatgcaatgcactgaaaaaaacacagcttcattgctggaacatcctgcacaaatatgtaagaaaaaaaaaaatcagacaaatccagtctaagggatgctctacaaaatgaccatctcatcatcttcaagaatgccagtgtcgtgaaaaacacagactggggagcagttctaggttgcaaggagactaaagggacatgataactgaaaataacacatgatctgggatcttcttgcactcccaagtacatttttcgaacaaatggtgaaatctgaatgaggtctgtagatcagaaagcaatagggtagcaagttcctattttgatcctgattttgataattgttcttggttatgtaagacagtgtccttgttcttaaggaatacaggggagtacatgggaggaaaggacatcttatctgcaacttagaaaagaataaggtgaatctgataaaatggaaacattcagggaatctggatgaaggctataaaggaagtctttgtactaatattacaaattttctgtgtctggaaaaataataaatactgaattaaaatatgggtagatttaagagtgtgcaatgctttccagcaagtctcaactgtgactgaagggcagaaccacctcaggagatttaaaaatatcaatgcccaggtcccagcccagaaattccaattcagttagcctgggaaggagctccagacatcagtatatttgaaagaactcccaaggtgattctagcagaaggcccaggggaataatgaaaagtcatttcagctggtggtattgtcagatgaggggagagctctgagctggggtctttctgaacccttcatgtctgttccttttgagggctgatcctgatatccagcacagtgaccccaaacaggagcagagtcctcctaggtccagtcgtggtcctgtatttaataagttgagagacctcatggcaaattccagcctgggttctctctgctgtgggctgaggttaacagagaacagcttccaggagaaatgaggttccaggaggaggatacatctctgaggtctgatgccccgatgcagtgggtgtgcagaggacagcctgacatcctcctggcagaaagagatgaaggcgattagggctgatcaacttctggtactgctgggaggttctgccacagttgggtgactgctggcagccctctctcccttcccaaggacggaagtttaggatggttctccggggaagggattggaagaagcaggaggacacccattatcccccacgtggaaagcaggtgagctggggaggccaagttcccaggggggactagggtggccgcctctggcccctcacgacgcagcctgatggggctctgtaaaaggaaggcgtcttcactgagaactaaggcagtgtgctgatcccagacctcaaagctgccctgctgtggacttttaaaacttccatgcccttctcaaccttctaacactgtgctgctgtggccccaggtcacacgtggctactgagcccttgagatgaggccaggctgagttgagatgggctgtaagtttaaaatacaccccaggttgtcaagtcctcataagcaaaagagaacgaactatctcattaataattaatttttaaaaccttgaaataaaaatgtaagctttgaagtctcataaaaatatgttttaattaaaaaaaaaaaaactactgattaaggtggaaaggatcatactttgggaacactgggttaaataaaatttcctatgaaaattcatttcacctcttttactttttctagtgtggctacctgaatattcactgaaaggactgatgctgaagctgaaactccaatactttggccacctgatgtgaagagtcagctcattggaaaagactctgatgctggggaaagattgaaggcaggaagagaaggggatgacagaggatgagatggttggatggcatcaccgactcgatggacatgagtttgagcaaactctgggagatagtaaaggacagggaagcctggcatgctgcagtccgtggggttgcaaagaatcagacacaacttaccaactgaacaacaacgaaagaatatttaatattaccttcatggattacatcatatttctattggatagctcggtttctaaggtctgcatattgtcctttcaaaattttaattccctggtgataattaaattaaaatccaattgaggaaggatttagtatgcagtggagtcagccctgggccccaaatgccctgcagtgagaaatgcttagccgtttcccctggttctcaggctttggtgattccagcaaattcactcttccccacaacctgagaaaaagcagatatggacaagtaacgtccatacctcacagtttgctggaataataatgattatgatgtaaatttacaaccaagtacttaggcctgcaattttaacccaatttgtgaggctgaatcactaacatttgatcttcttaagactctaaatatatcatactgcttatatgctacctaataatttacctttgccacagaaagaaaatacataagttggtaatgaagatgaatggtgcatactctcaagaaaggcactaagtaagtaagaaagtaaacagtctctcagtcgtgtccgactctttgcgaccctgtggactgtagcctaccagcctcctccatccatgggattctccaggcaaggatactggagtgggttgccatttccttctctaggggagaagttactagcagtctgttaatgaaagaaaggaatgtctcaaaaatcagagaatggcaccaggcccctcacccacaagatgtattttgagataatcttggcaccaggtgagtcatcccgggccataaaacgattgatttgaatcttgtagaaaggcagattcagttcagttcagtcgttcagtcatgtccgactctttgcgaccccatgaatcccaacacaccaggcctccctgcccatcaccaactcctggagtttactcaaactcatgttcatcaagtcagtgatgccatccagccatctcatcctctgtcatccccttctcctcctgccctcaatcttccccagcatcagggccttttccaaggagtcagtgctttgcatcaggtggccaaagtattggcgtttcagcttccacatctgtccttccaatcaacacccaggactgatttcctttaggatggactggttagacctccttgcagtccaaggaactctcgagagtcttctacaacaccacagttcaaaagcatcaattcttcagtgctcagctttctttatagtccaactctcacatctatacatgacaggctcttccgtccatgggatttttccaggcaagaatactggagtgggttgccattttcttctccaggggatcttcctgactcagggattgaacctgggtctcccccattgtactcagacaaagactgcaggcacgacggtgcagaacatcctgttccgtttcgccgagcgccacaacctgacggtgcgcctgccgcacccgagctgcgagcaccagttctgccacccgcgtaacttctaggcgcacttcgtgcaccggccgcacggccgccgcacgtgctagccagccacctgcgcttcgaccgcgcggagctgcagcgcctcatgccgcccggcaccgtctacgtcaccatcctgcgggagccagccgccatgttcaagtcgctcttcagcgactacaaccagtaccccaagaaagacactaaggctgtagcaagtcacagtccggaaggttccacggaagactgtagtttgagcttaggttacacgtcactgtctgactgcattctgaggatgaaaggcccctcacttgtgtgagtatgtgttggtaagtgtgtgtgcatgtgcgttcagttacacacacacacaagagcaaataactaagacactcctttggccagatttccttgcagtaacaacctagagccatggagagtcatggtagatttatctttgtttggtttccattctcatccgtggtctgactctatcttggaccacatatgcaacatggatggtgcagtccgtcttgtgtatgaggtctacatgttaaatttcccattatggaaaaaatacaaactgaattcagtgactgcccaggtgtttaagggagcttcccagaaaccaggaagaaggaaatagaggctgtttcgccaaggaccggtggtggtgtatgcagagcccaaaagactggtttgggtgaaaagtcactcccataaggtagaatggtgtttgcaacatcgtaaaaaattttcccagcccagaagcttacaacatactcagtattcacagttcagctgaatccaagggttgaataccatgctttggtttttttttaaaaagcacagtgtataatgtttgttaatattaacacagagacatagatgataaacgtgtactctatattaaaatgtccatggggtgagaaaaatcactgtccaatgtttaatatcaggggaaagaaacaaccaggaaagcacaaccttgcaaaaaagcttttttctgcttattttaaaaataattttatttatttatctttggctgtgctgggtcttcactgctattgcaatgtgtttgcttcttatttcggtggcttctctggttgcagaacgcaggctccagggcactcaggctttggtggttgtggcacataggttcagtagttgtggctcccgggctctagagcacaggctcaacagctgtggcacacaggcccagttgttctgcggcatgtgggatcttccaagaccagggattgaaaccctgtcacctgcattggcaggcagattctccaccactagctcactaaagaagccccttttctgcttatttttacatttgtacccacgactgatgatgagcatggtacataccaagtgcaagagtacataccaagtgcaaggagcatttgggaaaatcagtaacgtctctatgtctacattttcaaatgtgtactgataaaacagggactcacagacatacagaataaacctatggttaccaaagggggaaaggagaagagagggataaattgggagtttgagattaacagatacacactactatatataaaagagataaacagtaaggacttactacagagaactatactcagtgtcttgtaataacctataatggaaaagaatctgaaaaagaatatatttatgtgtatatatatatatatgagaatcattttgctgtatacctgaaatgttgtaaatcagctatatttcaattaaaaattaaaaaataattttttaagtgtattaaaaaaagagagaagataatgtaagaagacgctctgtatacgtgtctatatatacacacataaggcttccccagtggctcagtggtaaagaatctagctgccaaagcgggagcagcagaagacttaggttcgatccctgggtcaagaagatcccctgaaggagggtgtggcaacccactccagtattcttgcctggagaatcctttggtcacaggaccctggtgggttacagtccatggggtcacaaagagttgggcatgactgaagcgtgcacatagaggaaaataacaaatatagtcaaacataattttacttttattctaagaagtcatatgcattttagagatatactgtgtttgctttgcaatgtgatgccttttcattaaaacgatttcaagggaagaggctttgatttcttaatatgaatggattcagagaactcaagttctctcacaccaaaatgggcagaaatgagaaaaaggagcgaagccctcctgttggacaacattcttacatcacccactttaaaattaaatctgaaacaaagttctgacaggcctgctattttcttcagtgccaagaggcacacaatagacctttttttttggacaaagctcttaaaatgcttggagattcagatgtactgagtcacgaaactgtacaaatactgcacacccattcccgccggtgcccctgcccgctcttttggaaacaatgctatattttctctgtgtttggcagaaggaaagaaatattttaattagagctgcaacctgtttgaaagaagggtgacagcaacgcaagctctgacatgggtagctgtcctctgggccggtggcccctgggcagaggtgggtagttatcatttcagaggaatctgcttgattctcctactcagtgtgggctcggtaagtcccacaaccactgaaactgcaaatgtggcctgataaggtgatgacattccgcacagaagagtggacaggttcgccctgaagtagcgctagatgattcacccgtgcaatcaacactctcagatccatctttgaacgaaagtctttatataacatgcagtacagagaaggcgttctcatggcaagaatactggagtggtttgccattccctcctccaccgattcaatggacgtgaacttgggcaaactccaagagatggtgaaggacagacaggcctggcgtgctgcagtccatgggtcacaaagagttggacacaacttggtgactgaacaacaacaacacatagaagaggacatgaccttgcatagaaatatcagctcatctatgtgcttgctgtctgtgggtgcaaagatgggggcgggggtcagagaaggtgcaagaggaacagaaacaggatcagagaaggaggaaagtaggggaaggcagtgggaggaaccaaatctcatggttttcaagacttgctgtcttccttttaaaaatcaaattgctcccccgcccaccccatgcccacaactgccttgctgatgttgtgaaataattgagaagtgttgcaaagacatccttgcactgtgagcgagcaactgacttcaagtctcaacacctctccatctagaggggtattttagattgacgttaatgatggtgagtatttgagcttgaaataaggaggacaaaaaggccagttgttgtttagtcactaagtcatgttcagctttttgtgatcccatggactgcaacacgccaggcttccctgtcctccactgtctccctgtttgctcaaactcatttccattgagttgatgatgccacccaaccatctcatcctctgtcacccccttctcttcctgccctcaatctttcccagcatcagggtgttttccagtgagttgactgttcatatcaggtggccaaagtactgcagcttcagcatcagtccttccagtgaatattcaggactgacttcctttaggattgactggtttgagctctttgctgtccaagggactctcaggagtcttctccagcaccacaatttgaaagcatcaatttttcagcacaggcaagttctgtaaggaggtgagggtggaaggaacatgaatataagtcccctcggcgggagtgtgaggacacacagctgtgcctggattgccatgtccttggctttgaggaactgagagttttgggtggttgtgtaaggtaagctggccctgagaagagcgtcgtggagctgtctctaggttttccacactcaacttcagtgtttaaaaatatgtcacaccttcttgacattccaaacatgtaggaaataaaaccatggcatgtcggctggtccggcccagtattcctcagcctcagcgtgaggaccaggtcactccctgctgtgggggctgcgccctgcactgtaggtggtttagcagcatccctggctgctactcactagctgccaatagcacccctgctgctgctaagtcgcttcagtcgtgtccgactctgtgcgaccccatagacgcagccaaccacgctcccccatccccgggattctccaggcaagaacactggagtgggctgccatttccttctccaatgcatgaaagtgaaaagtgaaagtcaagtcgctcagtcgtggccgactttttgcgaccccatggactgcagcctaccaggctcctccacccatgggattttccaggcaagagtactggagtgggctgccattgccttctctgaatagcacccctagttgtaacaaattcaattgcctccagacattgtcaaatattcctcagggaacagattttttctgggttgagaatcattggtttattttatgattttattgcttattgaaacatagttgatgtacaaggttgtgttagtttcagatgtgcagcacagtgattccgtgtttttgcagatataatccattacaggttattacaagataatgggtatatttcccagtgagtgtgtgcatgcgtgcacatgtgcatgttcagtcatgtctgactcttggtggccccatggactgcagcccactgtagcccaccagtctcctcagtccatggaattttccaggcaagagtactggagtgggttgccatttccttctccaggggatcttcccaacccagggatcgaacccaggtctcccgcactgcaggcagacactttaccatctgagccaccagggaagcccataattcccattattacagagtaaatgcttgctgcttatctattttatgtatagtagtttgtatctgttaatccatgtccctaatctatccctctcatctcctctctgaactttggtaaccactagcttatatgtctatgagtccatttctgtcctgtatacatattcagttgtattaatttttcaactccacatataagtaatacatagcatttgtctttgtcttcttttgttaagcgtaatattgagaatcactggtttagactcagtgttagaacaagcaaaatttgcattgagtgaagatagctatctactctaaggaccatgtggaatctttggtgaagactgacaagccctaacaacccgccttgatcagccagagagaaacacagaagtccgagacaaaagcaggcctttttcctcaaagtgctagtttatggcttagggacccataacactatttacacataaccctgggggaaaaaaatcttggggccctttgttttaaaaaagaaagagtccttcacacttaaagtgagctttaaagaagtgaaaacacggaaggccacaggctctgttctgtagaattcacagcctgcaggactgactccacacagcaggtcctgcagcattggggcctcggagacccctttccatcctgaggctgtggattggacagcctcaggatggctttacatccagtctgacttattcacaaagcatttggtatggttagccttgggagatatgtttagcctcacaaaacagaggaaggtgtttaaaaacaactgtcccttaattttaccatcacatgaacaaaaaaggcatgtgagcctgaacttgggacagtgtacatctttttttaatagaaaggagagtctaatcttatacactcccttaagcatatccctcaaaagctgtacaaattagccttctagataagatcatgcgttctcatccccacctgtctcccagtgaacaaacagagaacagaaagggctccctgacccatgtctctctcgttccagagtacagtactatgattgatttatgatttctaagcctgagaactttggaagccgccaaacatgaaaagagtgaaaaatcttctaagtcaagagaaaaaagggaaggtcttggtagcagagcgcccttctcaggctctgaaacactactctgaaagctgtcacgagtatgcatcgcttgggcccttgcagacaaaaagggttattttatccagattattcccccacattgcaggggaaaagggactcatttgtaatcatcaaaggaatgctgacagacttgaaacgggattacattctattatcctcatccgaattaaagatttgttttggagatctttcttaggtttcttcctccctgctcctccaactccaaatgaggtgatttgtattcgtgggacatctgaggcagacatgaaatcagacggtttgcaaacatacatttcagattcagtggcctgagttttgaattttaatgtggcctggttctgtgtgtttggaaaactaggctctcaggttgagagtaaccccaatcatcacttcacttcattccctaactaattaatgcaggagacattcaacatcaggagcctgagtgaacaagggatacagatgtccagaaatgcaagtgtggaagtggaaaatcaacccatgggcagtgttgatacgctcgttattgttattattcagttgctaagtcatgtccaactctttgtgaccccataggatggatatgctaataatccctcaattccaagctctgtggtttgggtaccatttgaagaacgtaactggccaaatctattcttcatccctcaaactgctttgtgatgagtgcccatgaaaccactgagaagggagcctccccgggacagactgactctttagagcaggcctatatgatacttagcatagcatctgagacccgaaagacttgagaacgtttcctgttctttcagacagaccttccattatataatcacaacggaactgatgcccactgggaagaagtcttgggtaactcaggtcaaaagccataagtcagtggaagagttcaactgggtcaaaaagttcaacaagacaaaaagctacgtcttgatcttagctgatgaaagaacaagacatcttagagaaaatctcaaggcaaggggatgacactctctaagcaggaaagagcaaagaatataggtaaagtgcattagaagctgtaccatttctttgctcgtcatgtttttataccacaagccttctttctagacttactgttcttcaggaagtatatcctctggtagttctttcagtaaggatttattagtggtaaacatgtccttacttcacactcactcttgcagatagtttagctggttatatagctctgcactgacagtttttttccccagaacctggaaaatatttcactggtttctgactgtcattgtcatggcaaagcccttccaaatgaaaaactttccatctgattgttttaagaccatcactttgttttagtattttgtagttttagtatgatagacatgaatttattttgcttgggatgcttgaatctgaatcattcatcaactcttcaaaattgactctaagatattatcactttgagtgttgtctctccctcgtttttcctattctctctttctagaatactggtcacctgtgtgttgaatcttcattccattttccatgtcttataaggttttcgtttcatgtctttatctcttttactgcattctggataattttcctagctttattttccagttcactatttctctcttcaactacatttaatctatccatcaagccttgaacctcagtgaatatattttttcatgttagttgatatatttgactctataaaaaaaaataggcctgccctttcttgatagcgtttcattccttcttcttctggattcttttatttctttttgtgttttatattccctcttatttattaaacactctgtggttttgctgctgactgctgttcatacagtgcatttttgactgtgtgttcacaatcagcagaatttaatctaccagaatcttgtggggcctgcgttgatgttgctatacagggaatattcgtgggttttttccaggtaccctggggcaactttttgagtttcttagcttgggtttcctagtaatggcaatgtgaattcaaaccccagattcttgcaaaggtaagtgtgtggttacatagtttcaacaaagattattttttcctctaaccctgagcctcttgagaaatctatatgcaggtcaggaagcaacagttaaaactggacatggaacaacagactggttccaaataggaaaaggagtccatcaatgctgtatattgtcaccctgcttatttaacttatatgcagagtacatcatgagaaacactgggctggaagaagcacaagctggaatcaagattgccaggagaaatgtcaataacctcagatttgcagatgacaccacccttatggcagaaagtgaagaggaattaaaaagcctcttgatgaaagtgaaagtggagagtgaaaaagttggcataaagcttaacattcagaaaactaagatcatggcatctggtcccatcacttcatgggaaatagatggggaaacagtggaaactgtgtcagactttattttggggggctccaaaatcactgcagatggtgactgcagccatgaaattaacagacacttactccttggaaggaaagttataaccaacctagatagcatattaaaaagcagagacattactttgccaacaaaggtctgtctagtcaaggctatggtttttccagtggtcatgtatggatgtgagagttggactgtgaagaaagctgagcactgaagaattgatgcttttgaactgtggtattggagaagactcttgagagtcccttggactgcaaggagagccaaccagttcatcctaaaggagattagtcctggatgttcattggaaggactgatgctaaagctgaaactccaatactttggccacctcatgcgaagagttgactcactagaaaagaccctgatgctgggaaggatttggggcaggaggagaaggggacaacaggatgagatggctggatggcaccaccgacttgatggacatgagtctgagtaaactccgggagttggtgatggacagggaggcctggcgtgctgtgattcatggggttgcaaagagtcggacatgactgagtgactgaactgaactgaactgaatcctgagcccaagctgagatgttcccttgtcatctttctttgcaagaatgctgatttgtttctcacgcacctttttatgagtgtttagcccttccaggccctggccttataaggagatctttattccaattcctcacttgacattggtctgatgccttgtctcttgccctcatgtacccagtaaattctgactataaaatgcatcaaaggccccagtgtagccacagggtcagagccagctacttcttcagttctctggtctctcttcattgtgttccctggctagtccttgtgtttctccactcacccaagcatttgaaggatgtttgctatattttattcagcagctttagatgttttgttgggaaaatacttccagaacaccagttccaccatatttccaagaaatgaattatataccctatttcataatcagttatttggagctggatggtgctatctcttgatgcaacatagaatggacaatacctgtaagtcctaggaaagatttggatctgatatattaagagataaacataagaagtgacattgttttaaccaacttataattgatttgctttagtattagagaagctgcctgcattcaaatctccaaaagttacatacgctctctggctactatttcttcaacttatagagaaatttccttcatagggttgtgcggattaaatgagttaataaacatgaagtttttaaaacactgtgtggcataaagtgctttatgtatttgatacattataatatttttagctaacttctcttacttgtgctaagaaaaccaagtaaagaatttgccccttattttgggtcagagtttaacctgaggtagtgcacacataagggccagggaaggagtagcagaattagagccctcaaggggaaagaggggcttcccgggtggctcagtgataaagaatccggctgccaatgcaggagacacaggttcaatccctgggtcaggaagaggaaatggcaacccactccagtattcttgcctggaaaatcccatggacagaggagcctcgtaggctgcagtccatggggtcgcaaagagtcggacacgactgagcatgcacccaaggggaaagaaagaagctcaaagaaaacagtttagaatcacctggtcagccaccctcccatctgagagactcctcccagtgctaaaacctaggtgactctaggatggatgttatccagggaagctagtgcattctagaaatatacagacacaccagcctcattcaagtgtcatgaaagtccacagtgcctcaccctatgcatccacattcattacttagcttgaatgacaagagtatggatttttgaaacgagataattactggattattacattcttcctctaaattttactggcagttgtgggaactggcacggtgggcaaggaggcgatagggctgggccacaggggagcagttgctgtttcaatgttattgcccccaaagtggtgccttttcaagaattttgcaagtgctgtcaggatggctgaaaatactagtggtctcaaaaaatttttaaatcatgaaccccaacagcaaaaacattttgagaacacatctctaatattgcatttagaaattgtataatgaatcaactatatttcaataaaataaaattctaaaaagaaatgatgaactgttgtactgtcaagttgcatgttttttgtttgttttgttagacatgctgaatagctagcaggatcttatttccctgaccagggatggaacccaggccacggcagcgaaagtgccaagtcctaaccactggactgccaggaaactccctcaatctgtatgttaattagaagcaagacagagcttcttttttcaagatagaaatgaatagaaaaggagttctaacatctttctactatacccactgattgccttgtgcccacacctactgtggatcaacagtgttgagaagatgttgaaggaagaaatgagaaaaggtcagtctactcagaggacaattgaaatcgctatgatgagtcaagttgagttcagttcagtcgctcagtcgtgtctgactctctgtgaccccatggaccgcagcacgccaggcctgcctgtccatcaccagctcccggagttcacccaaacggagaactatctaaaaaggtcaggcaaattgaggcatttttctctggctttgccccccactcagcacccacacgggccaagtcctccagcctggccccacccctgggcccgtgttagggtatgcctctgcttccgagctgggggtctctgacaagttaaccaagccctctgaggctgggtaaagtgagatttctacttaactcagaaggttgctatgaggatgaagtcagataacactatgctcaactaattttcactcctttcttttctcttcctccctcgaaactactgctaggctgccttttccaataaagcgcctgggagaccaaagccatcaattacgggaccactcgcctgcccagactcctcttcttggctacagaaagagccgtcagaacgctttttgaatgtagttattttccatggaaacaggctagagctctgagatgcttacttttcatccgtcttcttctatgacagctggacaactcctttagacacctgctttgttttcctttggtgacgagctgccctttggctccatcaaagttttgaaagtgaagacaatcccaattaaagtatgatatgaccaagggatgataaaaggcagacctgtgtgacctgcacgtctgtgtaagtttgtgcatacctgtgtgctgggacacagcggcagactgagagcagggaacatacatcctggtctccctggcaatgagccctggggcagggggtgggggaagtgggacccagtcacacccatgtacccctggatgaactgtgcatggttcatccctgccctctgacatgggcagcagtggtcttccactctggctgcactctagaattgcctgggggctttgaaaaagagatccatgcctggatctcccagatgaatttcatcagaagccctgggttgctgctagagcatccatatatttgtttagacttgagggatgttagtgtgtcagccagggttgagacccactgtttctctaagcataaaaggaagcttcaacctcttctaaacggaccactccatcaggacagagttcccactccagggatcccaaccaatggaacaaccatttttctattttctgaaattcttttttttttttttttaatttggctgcactgggtcttcactgttgctcgtgggcgttctctagttgcaggggttactctctatttgcggagcttggacttctcattgcaatggcttctcttgttgcagagcacaggctctaagggaagcaggtctcagtacttgcagctggagtgttctagagcacaggctgagtagttggtggtgcatgagcttagttaccccaaagcatgtggaatcttcccagatcaagaatcgaacctgcattccctgcattggcaggcggactcctaaccattggacaaccagggaagtcttacattctgaaattcttgaccagtgaaataaggagttagggtcaggcttatttgctaggctgcaaatgatctgataacaagccccacatcttgtcttgcccacttgggctactgatggaggcaggcagggtaggacaccagcctggagacccccttcgatcatgcaatgacctttctttgtggtctggggacatctgggaacaaggaaggccttaaaacactctccttgtttctcacttcctttctgtttcccacatttaccattccatgcccgagggtaaaaccaaatgtgtcaacatatgatcatgactctttttgtcaaaagtcaggagttttctaggaatccaagtgggaacatgattaattttccatctgttccttccctccctcatcagtccatcaatcactttgagcatctttgagaagaaaaaaaagaaaaaaaaaacagaagagggagaaaaggaaagagcagagagagaagaccgtacctgctctctgcagggaataaaaccatcaacagtatatagataaagaaacaagatgggacgtccctggtggtccagtggttaagaatctgccttgcaatgcagggttcagtccctggtcagggaactactgataggatcccacgtgtctcagagcaatgaagcccatatgccacaacctgagagtcaacgaagcccaaatgccataactcaagagtccaagcgccacaacgaaggagcccatgtgccaaaactaagatctgacacagccgaataagtaaatattatttttttaaaaatgaataagacctgagggacagggcatactaagttcagagacacaccaaaacatcactcttgaaagccagaccacatgcagaaaggatctttaggatctttttaatcgttggaaccaaaatggcacccctccctccgctctgccctcatcctgccttgttctttgaacaaagatgatgctgacattgtatttctatatatgaaaaaacatatatacatcaatgatcagtttggacctctctggctaaattctcaagttgggaatgcagtcaaaagaacagaacgctatcccaaagaggaaaatggacgaaagccaagcgcatttgagtttgggattaaggatcagaggcactaattgtgcatgaactgttcttgccttcctacgatgtgtttttaatgcagtgatgatagtcttccagtggccgctggcagcatctcaatgtctttagggaggagagggaagggggtgtttagggagcctgtttcctagcaggcttgaaggtgattagcaccagtcacgagcatgaagggggaggagaggaggccctgatgcagcctctggcttattaagagtgagatctgatgctggaatccccggggcaaaaaaaccaatgacccaggaaaactacaccagctgacagcctcagggaaaaaaaaaaaaaaaaagctcaaggaagagttgcaaagaagagaaaggcttaagtaactttccaaaactctgtgctgctaatctcccaggaggcccaatactgtacagacaaaggctaggacccctttcatttcagcactttctttcacctggattcaccatcctgcttccatccccttcttcacgaaggctgaaagggtcccaagttccctccaccctccatctgtctggatttttgatgtttccttgtttagaaaaacaagcaagcaaagacgtcaaatgcttttctccagtgctcagctattgctgcaggctccgaaggggagggcccactgtctcttttcaggcactggtttctacacacccctctaagttcaggaacagggtctcttcttcccaggaaggcaggaatcaggctttgaggccacagaggtgcgagttgaggagggggggatgtgtgtgtctgtgtctatgtgggtgtatgtgttggagtcacatgaccaggatccactgtgtcaactgaagttttcaactgaaccctcagactgtcatctttggagcttaggaattttcttggatggtgtgtgtcatgtggctgggggggtccctaaaggttcattaagtttcaagtcaaatgaatcaattttggaagacgttatctttctccctgagccttttctaatatttccctaaagccatacaagctagaatttagatctaaacgtgagtgtgtctgtgatttcagacgaggttatttttcttttcttctccccaaaaggctcccaaacactttctccctggtcttcagatctctaaagagcaaggttgaccagagaaaacatgggggttgcctggcaatgtcaccatcaaccgaatattggctcagggagtctcaaaccctggaatctaggttcccactaaaagcacaagaaattttcttttatcgtttaatcatttagagaaatatgtatgaaaacatccaagttcacagcatccctgtttgacagctcaagttcaccctctgaaacagttgttaccttcagacagttccaaacttgggtggtaacctatagactgcttcaaggattgcaaccgcttcactaaggaaacaagctctaagtgcctgtaatctgtgagaacaatctaatggttacaccgcaacggtacctaaagcaatatttgttcagttacagtgacgtcacactgtagaaaggcttgttggctttctgttctttgctcaacaatattctcagcctgccggtggctgaattcagattgctttccatagcttaaatcagcaaagacagaacttttctagcagccaagaaagttctattaccaacaaaaaaaaagtcaatagcacttgaaattcagcattttttcccagcacatttaccacagcgctctgaccctcggtcttaaggacctcagtttccttgccaaataggcatgtcttggcttcctttgcgaggtagaaacactgccttgatattaaatattcaaagcaaagaacctctgacccgagggctctcagctaacaatgacattctctgtaagtaaactagaaacccaactcagcttctggtttgccagtgtcccttgccatgtactagcatattgcacaaacagggtctgaggaaggagccttgttgactgtgattacaccgcaaaagaccttcaaggcagagatgcgggaagcccggccttgacaggagatgagggagaaggcaaagaatgggactcagagctgcttccggggctgggcaggggcgaggaaagggtgaagggccaccagcctcgccagacggagacccaggtctgatccacctttgcagggacgtctggttactctcagcaagcacaaaggtaatttaagaatgctgtccctctagcccccatcaattcagaaacctctctccctttgtggtgccccacctacaaccccagaactatctgagatcggctcagtccccgcccccccccccccccaaaaaaaagcctcatcggttactgggaggggaagtctttattcttttctttttttaaggcgacgggggctggaaggggccaactctggtgccttttggcggtaaagtcttacccctgtgtctcctctgtctgtactgcaagcttctactcatctctcatggcatttccaccggaccttccaccaccccactcccgggtttccctcaggtctgttgtcaaatgtctcctggactggtctccttacgtgggcacccgcgaggtcggctggggcacacccaaactgcgcgtaaagcaaaccaggtacaacgtagaccacaacacgtgtaccaacagcgctgagctcggtgcacaggactcagcgtaaggtgctttaaaccgatacgcatccttcggagtctggtccctgaccctgggatactgacgaggtcaactcatcgggagacaaactccaaattctacccacccttctttcttgggggaccccctctgccggcatcccacatgcagctacttatatgcgaagagttcgcatcaggcaagaaaaagttagggctcctagctcgctctaactttcaagcaacccggccttgccccctcgggcgccggcccccaaccgagggctcaccttagcgccccgcggcgccggggggcgctcagccagggaggtcgcttcttaccggagaagtccgtgagcgccgcgatctctctggagcaaaccaggacggtgcagtagaacagacgcaggagctgccccggaggctctacctgcctgcggaggccgggatgctgcgcgggttgcggggcggacggtgggcgcgcgtggcccggcagcagcatgatgtgccgcgcgacggagcgcgggcgcgggcccggggcgcacgggggatcgcgggacggagggcggcgtcacatggcaggacgagtcggtagccgacgtctccgcggccccctgccacctcccggcccaggctgccagcgcctcctccccgccgcgggcgagcaccggctccccagcgaagaggggggcggagacctggggcggggcgaggagccccgggaagtatccgcgtagtttccccgagaggaaatctctgctgcggacgcgcaggaggaaacgagggcggggggcgaagggaaagtgtagcccctccgcgcccccgaggctgccggaggccggggccctggcgcgctgcccgccgcggagggcgcccccaacagcgcgcgactggagcgccttgcacaccccgggtcccctccccgcccgagaccgcccggcaccccccggccaggcccgcgctggccccgtgccagcctcgccctggccgccggaggagcgcccgtgacgcactttggagccagcgccgcgcgctgagccagggagccccggggcggggccgaggccggggtgggggcctcggaaggtggggtccgggaggtgtgggaccgcagcactgacgtctttggcgaccggccgcgctccacgtgcagagtcaccaagcacgcactgttatccccatttcacaggagaggagactaagaccctggagccttggcgatcgccaaagctgacgcagccctgacgggaaccgttgcggggcggaggtgggggcggaaaggggaggcattgtgctccaaacggatcacatggtccagaacaggtttcttttagctgcctacttttcctgtgggtactaggagtcggccgcgctcaggatctgacgctgggactgcccagaccgcggccgaacgctaataaacgggctttgttttaaaatggggccacagcatctttctgaacctctcgatgacgcgcggggtaacctacgtttggacgccctgccagtgagcgaggagcggattttcgcaccgcccgggctcgggggacaccgaggacaagggcacgggggctccgtggatgcgcgccgggtgccgtacctgggggtccatggacacaaacctgcgcggggcatccgggccggcggggagggaggcgggcgggagcgcgctcggcacagagtgttcccgaacaccgcgcgagcgcctgccaagttcgctgcgggcctgacgcggaaacgtagatatgaggcccaaggcgggcccaggcgccctgcgggcctcccgggtctcaactgcccggggcggggagacgcgccgcaccgcgtgccgggaaggcctggagaggaaacccggagcgactcgctagcctacctgcgggaacctctgagaggtgggccgcaaggcccccggggctaggtgtcatcgcgtcccactctgtgctcgggaaggaaagattccggtcatttcctcatctgtctggggtggggcggggagcgcagcagatgtaaccatcaacatgtgttagtgggacccaggcaccaggatttttaaaacctacatgaaaacgttcagcttctcaataatccttgaacctcagtattcttgtgcactttcaaggttggggaaactgaggctgggggcgggaggtggggtgggtaaggatgcctagcacctagcagccattcagtaagtgacctttgctcaaaactcagtttcctccatgtaccttgcattccattgatccatctagtttggatgggagttaggtacttatgtgggctagatcctctgccaagaactgaatatgctggcccaggaagggaaccatgctccctcagggctgggggctcccaccactgttctgcaaggatgccagtgtgggcactgctcctaacggggacagcatccccaggcttccgtatctgtaaaggcggcaggcttactgtgaagatttaaggagtcgatacaggtgaggagggtaggaactgggcctggaaggaggaagtgctccgtcaacattagtcactggcacaagggaagaggcttccctggtggctcactgacccacctgttagtccacgagtctcaggttggatccctgggttgggaagatcccctggagtagacaatggcaacctgctccagtgttcttgcctgggaaatcccatggacagaggagcctagcaggcaacggtccatgcggttgcacatgatttagcaagtaaacaacaacaacgggtgaggaagacagacattgaactgataacgccaaatgaacagcaagggactgcaggagcaagacagagggagtgtgggaggaggggagggagtgagcaaggcaggtgttcgcaacctttttaagactgaggcaccagggaagtcctttttaagattacatgggtgagaatgatgggaagagttggtcaagcaaaacctaggaaatgtggggaggataaaatcttaggagtgttcttaggagaacaccaagtctcaggtggtgcagtggtaaagaatctacctttcaatgcaggagatgcaagagatgcaggttcagtccctgagttgggaagatcctctggaataggaaatggcaacccactccactattcttgcctggaaattccacggacagaggagcctggcaggctatagtccatggggtcgctgagagtcagacacgactgagcacacacacacactacatcccaggaaaatgaatgagcacgtgtgaaatccaaatggaacatagctccattgagaagcgtggaggggatgaaagagagagaaaagggtagggcaaggtgatgtggagaggtcagccgccagagctcagggaccagagaccttggtgagcgttgccatctttgtcctcagctttatgagcatttccatcttaagctagcaaactgttgtaagcagatgagggacacaaccaagtgtgtgttggtaacagatgactctgctgagtgcaactggactggagtggtcaacaatgggtccaggggtgataatacacccaaaagaatcaaatccaagagatatttgtgcatctgtgttcatagcagctttattcacagtagccaaatggagagcaatctaagcgtccatggatggatgaatggaagaacaaagtgtggaatcttaccagtcataaaaaggaatgaacttctgatacatgctacagcgtggaaacagcttaaaaacacgctaggtgaaataagaaaatgataagcattgcatgaataccacttacatgaaatatccacagcagaccaagttatagagacagagaagaaattaggttactgagaggtgggataaaggagaaaagagaattatttcttaatggatatgtggcttctatttggggcaatgaaaaagttctggaaatagctggtgatgatgggtatgtaacactctggatgtaattaacgccactgaattgtacacttaaagtggcagattttatgctgtgtagttaccataacttcaaaaaaaaaataatacgccaaaggtcactgaactgtaaatgggtaagttgtgtggtatgtgcattatatctccataaagctattttcttttttggccatgctacaaggcatgcgggatctcgattcacagggatgaacccaagtcccctgcagtggaggcacagagacttaagtgccggactgccaaggaattccccagaaagctgcttgttcatttaaaacctttttatttaaattttttattgaagtacagttgatttacaatgttgtgttaattactgctgtacagcaaaatgactcgtgcatgctaagtcgcttcagtcgtgtctgactgtttgcgaccctatggactgtggcccaacagtctcctctgaccatggaattctccagccaacaatactggagtgggtggccgtgccctcctccaggggatcttcccaacccagggatcgaatccaagtctcttaggtctcctgcactggcatatatttataggctttcctggtggctcagtggtaaagaacccacctgacaacgcaggagatacgggttcgacccctggattgggaagatcccctggagaagaaaatagcaacccactctggtattctttcctggaaaatcctatggacagaggaccctggtaggttacagtccatggggttgcaaagagtcggacacaactgatcaacttcactttctttctttttttttttttttcctaaagtacaaacaaagaccacgggtgagtccagggagatgctcaggaggggagagtaacaaggaggctgtgactgcacgctggcctggggctttgcaggcccagagagaagggggaagtggccagattggaaaggtgttcgggaaggatggagcaactcggcctcgggatgtgagtgatgaggctggaggacaagaccctgcctgctctctgctgtgcccctcatttgctccctgttaaatcacatcttagtcctaatctgatctctttaagaattttgacatcttgcaagaaaattaaagaattctatttatatttttctcctttcctcatactttgtgtactcccagcaaaatggaagccagttaccccctgctcccatttccctctctgaaaataaaccatcagatacctaagctctggggtactgactgggaccagctacagaattcactgctgttgttcagtcgctcagttgtgtctgactctttgcgaccccatggaccgcagcacgtcaggcttccctgtccttcatcatctcccggagcttgctcaaactcatgtctattgagtcggtgatggcatccaaccatcttgtcctctgtcgtccccttctcctcccgccttcaatctttcgcaacatcagggtcctttccaaaaagtcagctcttcacatcaggtggccaaagtattagagcttcggcttcagtagcaaaatggaaacgcgtggctccttgctcaaaaatcattacaaatttcaaggtagtgatggcagggcagtaaacccagcatggtctcttcgaacacagggccctgagtgactgcacaggccacgtgcccatgaagctggcccaggcactaccagtatgtccttgtctcaaatatagaaactgacaacccaactcatgaagatcaactggatccttgattcagttgaatcaattcagatcaattcagatccttcagcaggatctgaagtcctcttaaactgcaaaggcacaggaattaggagaaggatgctaagacggaataaaataaaagtgttgctttctatggaatggaccattggcccttcttgcatatgagcttgagaagtgcctccgtacccaggataattgttctgtgtctaagatgcatccttggcagacattgtaaattacgtaccttaattcctgccattttaattttttccttttgaagccaccctgttccttcttcacggctctaagcttccaccttattttcctccttccttgagatcctccctatgtagccaaatctattttggaggatgtttgtgtgctaggcacttcaactcccagccccaagccggtcctctctctaagccatcaggtaaggctttggggctctcaacaaagatgggctgcagctgctctgagaagacataaaccaccatttgtcagctgcaaagaaaccaacctttcagctcaggatactgaagcctaatgtcatccagagctaaaaaggcttatttttagaaagcaacaaacggtggtttgtttatagagctggtaccaaagagccacatcaatagcaaacagcacgcttactgaggactgtgaaagctggggatgtagcggagagaggctgccaggggaatgtttgacccaaacgtccttggaaggaggccttgaaggacaggggctcaacactggggttggtccaaggtccaaggcgtcaagtgcaggagtctgtacctggcccctgccacccacagaggcactgcacctccctgtctttcatctttcaagttttgcaagaggaaattgctggactcaaaatcccactttggctctaaaagcccatactctaaattagacgtaggatttcaggaaactgggctaaatctctactggttccttgacattccttaatgcttttgcttgtgtgtgtgtgtgtgtgtgtgtgtgtgtgctcttagttgctcagtcctgtctgactctttgtgaccccatggactgtagtctgccaggctcctctgtttatggaatgtctccaggcaagaatgctggaatgggtagcccttcccttctgcaggggatcttcccgatccagggattgatcctgagtctcctgtaccacaggcagattctttaccatttgagccaccagggaagcccaatgtttccttaaatacatattttaatttctttctttcttttttttttttgcatgttgtttttatgttgttcatatttttctctttgtagatgaagaatatagtatgaacaaatgtttttctggggggctgtttggttcttggagcattgtgaatgattaaattcagccaaatctggacatcagctcatccaatcctaaaaggcctcacactatgtaatcttgcttttttaaaattagtttttactgtgataaaaatatgtataacataaaatgtagcatcgtcaccattttaaaaaattcatttatttctaattgcagtattgtgttgatttctaccaaacatcttcaccattttcaaatgaaggtacagttcctgcaaccccaggaaagtctaggaactgacaagggcgccctctgtaggtgagactcttaatttacgtcttaggaatgaaccctggcctgtgaaattcataatcattttttttttattgtggaatcccggggacaggggagcctggtgggctgctgtctatggggtcacacagagtcgggcacgactgaagtgacttagcagcaaaacacatctgacctaaaatgtaccattttaaccatttttaagtgtacagtttaatggcatttggtacagtcacattgttgtgcaactattacttccatctgtctccctaacattcttcatcttcaaagctagagctctttccccattaaacaagacctctcctttctccactctccccaggccctgacaatcaacattctacctctgtgtctatggatctaactactctaggtccctcatataattgtgatcatacagcatttgtcctttcgtgtccaaattctttcacttaacatgaggtcttcaaggttcatccatgttgtagtatgtatagaattttctccctatttaaggctggatagtattccagtgtaggtgtacaccacactttatttatctttttatcttttgatggacgcttgagttgtatctgcctcttgatattgtgaacaacatggctatggacatgggtatacaaaaagaaaggaagaaagaaaaactgaatttaaatgatcattccccaaaaagtaaagtagtactaattgctcagtcctgttgactggggaaacttaaagctgctgctgctgctgctaagtcgcttcagtcgtgtccgactctgtgcgaccccatagacggcagcccaccaggcttccccatccctgggattctccaggcaagaacactggagtgggttgccatttccttctccaaaccaaaaagaaaaaaacctgaagtccattgatgggaattctgaatccacaaaagtgagtaccaattaagggtatagcagagagtcccaaactttctcaactcatggtggccttagggtctcagagactttttcccagggccctaggtaaaaaaaaagaaaatcaaattactgaattgttacaaatttatgaaatagttagacccaaacaacttagtaagtacttatgttctaacaattaagtacctatgtgaggggaaatgcacagcatttaaaagaaaaaatattttttcttttattcttaaataacctcagttatttactaaggagatgtgtgcacctattaggcatactgctatctttctaaccttgaaatcacattagacacttctacccttattttctgtttcaggtagatttttcttggctcttacttcttattataataaccactgaaatcccagctttgcaaaactcttggtatctttgacagaaaagtaacacacagaaagaaaaagaaaaaagaaacagagcacaattgaatgctcaaactatgaaatatcttgagttcacactttgcaacggctgtcaggaattgatgcatttccctccacttataaaacttgtccaatctgtgagtttcttggggcgctctgggcagctgggttcctgatttaagaactgcaaatctagactatttgaagactccagagaccttactttgccaacaagaactgcataaactgtgtctggatgactctccaacaacctcgctcatacgactctggccctgcctcccttgtagacacactgctccctttgctgcttcctgacccctctgattatgatgctgtctcagcgcctttgcatttgccgtggcttctacctggaatggtcccaccgcctccctgaactgccacagtgctctgaactaactcgttcagaactggccaccacttccattgtacaccattcaacttgacctgcctggcattccattggtcttcttgcactttcaaggttgatttgccccacacaaacctctttggaaatatgattacatgtgaagttagtgatccaggactacttcagtagcaacaaagtaaaattgcagtgttgacgtagttaaaatgttaccgagcatcaatactcagagaggagacctaaaggaggagaagacagcaagtgtcacttgccggggtccagccccggtggatccagggaattcgaagcggggacggcgtcggcgaggatcaggaaacaattgcttaattaaacgttaattaaggatataaagagtaatagaatgaggatagctcagtgaagaaattcagtggagaaaagaggctgaaataaggatagctcagtgaggaaattcagtggagaaaagaggctgaataattcagccagaaggtaagagaaagaacgacatggtgagaccaagttttggtgaacaaggcctgcactttattttccaaagtagtttttataccttaagttatgcacagaggataatgggggaaggggtagagtcatgcagtaagccaggctttcttcctgcaaacttatcatatgcaaaagtttaggtgatttgcatcatcttctggcccggaggcctttttctctaaaggtgattattctaaagtcaggcgccagcctccaaaaagcattagataaagttgcattcctacagagcaaaggtgtggtgggctataacaagaaaaagaatgaactcaagggtcccaggttacaaacattaaagctactatttacaccaattatattaatcaatacactgccagggacacagcaggtaagggatatggagacttagcagcaaacattggcccaacaagtgaaaatcccttcaccaatacaatttctaatcaatcttttaactgctcaaaggaatctgtatttagacagtttagaacatctcatgcctctcacagtttggaggctctgagcaatcacatgtggccggaaaaacctattcaggcaggctagaggacttccaagggagtttgtaggttgaaacactgtcacacccaggaattattaactggagctgtaagctaactcttttttcagagagaggtagtgggggacagccccccgtaaagtcagaggtgtaggtgaaagcacaaagcacaaagtaggcagactctggttttgggggtagattgctcgagaatttccagggagactcctgaggcttgatcccgcctttgcgtatgccaagcctccttcctcatgacctttgccaggggcggagctcgctccccgcagtcactcagctgctgagacctctaattccagattgtttctggacgggtgaagaaacccttccccgtctggaggaaggaactgcagtcttactgctcaggctgggcagaatttgtgtgcacgctttccaatacaccacaccatcattttcccattcatctttggggccatctccccccctccgtttttgctcattaaactttgttttcaggggtctcaaaattatgtgcctaagttttggtcaagttgtttccattaaaaagtgtttattttaaaagctaataatttaaaattgcccccctcctggctcagtggtaaagaatctgcctgccaatgcaggagacgtgagttcagttccgggattgggaagatcccctggaggagggcatgacactcaccccagtattcttgcctggaaaatcccatggacagaggagactgcaggctatagtccatgggatggcaaaaagagttggatacaacttagcgactaaacaacaatagtaacaacctccacctccccacccccagctcaccaaacattctctttcccttctgaaggtttttaatgaaacattgttatcattaaccagtcttttactattacatttatatggccaattgaggcaaacagtgcctagatcattcttttaccatctattaaaataggggtgcaggcattggggattactttagcctcctgaactttctaggccgactcggtgaccttgccaactccagcagcctgctgctttgatgacacccacagcaactggctggcccatgtcatgaacagtaaaacgaccctaaggaggatcagagaatctctcaacacacatattagcctcgcaagatttccagaacatggacccaccttctagcttcttctcagaaaagcagtcaaaactcctctgttcaacaaatctgcaagcaatgtgagctgtgtgacaactgcacacagatgcatggtgtcactggtttgtcctgaatggttcaggatggtcaggaagtcagctgcttccactggtaggtcatatttactgtcaccataagaatggttggagaaggaaatggcaacccactccagtattctttcctggagaatcccagggacggaggagcctggtgggctgccgtctatggggtcacacagagtcggacacgactgaagtgacgtagcagtagcagtagcataagaatgacgccatggcaaacatctttgatagacaccttctcaacactgaagcccacggactccccaggaagagcttccttcatggtgtattccaagggactggacttcatttgtatcactgcctggagccaagtgaccatcatgctgggggttgagaacagcagtctccacggggatagtaccagttccatcaattttatagacgtcctggaagggcagacagaagggcttgtcagtcggataagttggtagctggatgcaatccagagcttcaggcagtatggttgtgctggcacggccatctttatggatgactttccatggctccagaatgtcaccattccaaccagagctggcacaaatgctattgtgtcaggcttatagccagttttcctaatgtaggtgctgacttccttaacagtgttttagtatctctttctggctgtaggaacccttttgttaacaccaacagttacttgtttcacacccagtgtgtaagccagaaggacacgctcataggtctggagacactagcttcaaattcaccaacaccatcagcaacaatcaggacagcatggtctggctgagatgtgcctgcagtcatctttttgataaagtctttgtgtcctgggatatcagtgatgtcacgtcatacttgctgatcttgcattgccccagggagacgttgatggtggtactacctatcaatggggataccacactcactttaatctttcactttatccaagacacaggcacccttgaaggagcccttttccatctcagcagactctttctcaaatgtttatggttcctctgtcagcgccccacatttgtagatcagatgggcatgaacgtcagacttacctgagcggcgtgtccagtgatgacagagttgatgtgagtcttttcgtttgccgcttggcttagattcagtggtgggtttcaccacacctgtgttctggtggaaaacctattgttagtgaggagtgccatctttatcatttgtcaagttcctatatatgcataggtcttggttttcttttgaatacatttttaatcttggactaattctagatttgcagaaaatctgaagagaggaatttggtacagcctcacccagtttcatctaatggccatatttttcatgcatattttggtactcttgttcaaactaagagaccaacttgggtacattgctattaactaaactccagactttattcgttatttcactaacttttctgctagtgtccctttttctgtcccagaatccagtccaggccatcaaagtgtgtttagttgtcatgtctctgcaatcgaatctgctctttgacagtttcctagtcattccttgtttttcatgatcttgacagttttaaagagtatgggtgatgtatctttttagactgtccctccacttagatttttgtctgacgtctttaatatgattggggtcatagatttggggaaggatcctctgaatgtgaaatacccttctcatcacatcagggtgcatggtagcaacatcacttactgctggtgatgttaacctcgatcacttaattaaggtagtggttgtcatgtttctccactataaagcaaccatttttcctttgccatactctaatctttggaagctggtcaccaagcctacactggaggatgggggaggagtgtgtgaactaagttccacttcttggatcaaggaatatctacatatattattgggattacttttgtaggaagtatttgtaaggaagcttaccttgtaaggaagatcttttctcccatttatttacttttcaatcatttttaaagcagtatagacttataaatattaatttatacctgagattataatccaattgtttggattattttttcactcaaattgttaattattttgtcacaaattgttccagtgggaactatctcaggttggttcctaggtcccttggacatataattgccccccactcccccaccccccacttaaagcatttcttactttatggtactacaagatgctctgggctcattttatatgtgccctgtcacagccatttctccaaggagtcctagttccttttatttgataatggtattagaaatcaagatgtgggtgttgggtgtgctcaatgctattggggtatcactgcttataagttctgtcagtgaaaagagctgggaaatatatgcatgtgtacaaatccaggtacaacaaatatctatacttatttctgtatcagtttatctctttatattaaataggaggccaccaatgtctccaggctttatccagtcccacaggttcattctagccttgctgtgctgtgtttagtcattcattcgtgtagaactctttgcgagcccatggactgtagcccgccaggctcctctgtccatgggattctccaggaaagaagactggagtgggtcgccatgctgttctccagtcttcccaatcccaggagtcgaatccatgtctcctgcgttgcaggtgacttctttaccatctgatccaccagagaagaccatgaatactagagtgggtagcctatcccttctccaggggatcttcttgacccaggaactgaacctgggtctcctgcactgcaggaagattctttaccagctgggctaccagggaagccctaattttagccttacctttttgcttataagtatctaccttctttagcagtgagaaacctgacccccattatctcccatccatttgcttattgattcaactccaggatacatgaaaagcagtttcagagttgttaacctatacttccatgatacaggccttttttgagtctgtattctgtttcctaaggttatttgattccagcttgtgcttcttccagcccagcatttctcatgatgtactctgcatataagttaaataagcagggtgacaatatacaaccttgacatactccttttcctgtttggaaccagtctgttgttccatgtccagttgtaactgttgcttcctgacctacatataggtttctcaagaggcaggtcaggtggtctgggattcccatctctttcagaattttccacagtttcttgtgatctacacagtcaaaggctttggcatagtcaataaagcagaaatagatgtttttctggaactctcttgctttttcgatgatccagcggatgttggcaatttgatctctggttcctctgccttttctaaaaccaacttgaacatctgcaagtttgccgggagaaatatcaataacctcagtatggcagaaggtgaagaggaactaaaaagcctcttgatgaaaatgaaagaggagagtgaaaaagttggcttaaagctcaacattccgaaaactaagatcatggcatctggtcccatcacttcatgggaaatcgatggggaaacagtggaaacaatgtcagactatttttttttggctccaaaatcactgcagatggtgattgcagccatgaaattaaaagacgcttactgcttggaaggaaagttatggccaacctagatagcataataaaaagcagagacattacgttgccaacaaaggtacatctagtcaaggctatggtttttccagtggtcatatatggatgtgagagttggactgtgaagaaggctgagctttcttcaaagaattgatgcttttgaactgtggtgttggagaggactcttgagagtcccttggactgcaaggagatccaaccagtccatcctaaaggagatcagtcctgggtgttcattggaagaactgatgctgaagctgaaactccaatattttggccacctcatgtgaagagttgactcattggaaaagactctgatgctgggagggattaagggcaggaggagaaggggacgacagaggatgagatggctggatggcatcaccgactcgatggacatgaatttgggtcaactccgggagttggtgatggacagggaggcctgacgtgctgcgattcgtggggtcgcaaagagtcagacacgactgagtgactgaactaaactgaaggttatttgacttttttttttttttaccattaccattctaatttgattattataactttaagatatgtctttatccaaaaaagtctttttcagttagctactcacagacatttatttttctatacaaatttattgtggatttttttagtttcttgattttgactggaatggcaatagtttcttttatagcttcatttagaaagacttaacaaatatgcaccgtgaagaccttcgtccatgaatattttactgtctagttagtaagatcttcttttacaattttctccttaaagatgttgtgcagtcattttaactctgagattacttttagttttgaaagtgttttgaatagttgtttctaaatatgtttgtaattatatttaaatatttactatttaaaatttatgtttgtataatgttttactcctgtgttttgttgttttgcatcctttatttttccatcctcactgatcttgccacacgtatgtttacttaatctaaaaaccaaagcaatcagcttttggtttgtgaatattctttattgtttttctcattctacttgtaactgatttggctccttatctttgcttccttttccttcttacttcttttggttattctattgcactttttccaatttcttgatttgaatatgtattatcagttcatttgttttcagtttttcttgctttctgatacatatgcttcaagctataaattttcctctaagacttgtgtcccacagattaagcaatgtaaagtgcccattttattgcattccaagtctttcataaattccctagtgcttcccaaggattatttagaatttttttccctctcatagacttatgagattttaaaaagcctatctttttattatcaaggtcaaattttactgcctgatggtcagagaacatggtctgtatgatattaatttggggggaatgaatttgcaccttctttgtggcctaggagattgcccatttttatgacaattccattatatttaagaagaaaatgtattctgtttatgtgtgtaaagttctcataccatcaattaatttgaatacattgacattcagattttttatattttttcatatttctgtccagtgactaagaggttaaactagttttcacaatagctttgaaatttatcattaacattttaatctctaaactgggtatggattttgctccattttgctgttcaaagaacagggccatcaactcaataacctagtatttttgaagagtctggtctgagatctggtcatcaatacaatatatgttaattgaggatatgactcttgtgggacttgtcctagcagaatcagtgcaggggcttccctcgtggctcagatggtaaagcgtctgcctacaatgtgggagacctaggtttgatccgtgggtcaggaagatcccctggagaaggaaatgtaaacccactccagtacttttgcctggaaaattccatggacagaggagcctggtaggctacggtcagtggggttgcagagcatcggatacaactgagcgacttcactttttttcaccctcaaatggatttggaagtatatttttaaacatgagggcatcctcccccccaagtataaaatgcaatatatggcacaatggctggaattcacaagcagattcacgcagaatgttcagaatacccccaccccagcccccattcaataccacagtgactaaaacacacctacaagaaattcacctggggagttgtgatctccaaatgtcctcttttaatgtataaaccatttgtggattggttgcaagttgatattattctctaacaccttatggttgttgtcgtttagtctgtcatctgtgtccgactctgagaccccatggactgtagcctgccaggcttctctgtccgtgggattctccaggcaagaatcctggagtgggttgacatttccttctctcagggatcttcccaacccagggatgaaactcacatctcctgcattgacttgtgtattctttaccactgagctagccacctgggaagcccatcttacggtgaatttaccaaattcacctcttttccgatgaccagctagaaacagcttttgtaaggaaacaggttaagcagaaagggtagggaagaagggggacttagcatacagagtgaggcacaaaaataagtacttccagggatataaattctggaaagttgtggctgttggggctttgggaagatgggagcagcaagaagctgctgtgtgcatctgtgaggaggtgggtgagcagagagtggacctggggaaatttaagaagacaaatgtcatctatgtcatgatttttatcaccggacctcacacttatggctagtttattccatattggacaagaggggaacattttctgctcttcttcactttagtctcagagaagaaaaaaggacaaatttgatgcttatgttttcttatctttcttcagtaagaaattcacaatgacttaacctggatcatactagtgtgatgtatctactgctcaaatattaataatttgtttaataattatatggtcttgcaacatctaatagcatcttcggttcttcgttaaattctgttgtgattgaacttatcaggtgagtcgcgttctcagtgacactgtaaatctcttaagggtaaggctgctgtgtaagacttttctgaatctattatggctggctgtctagtgcaatgcacatagcaaatattatgtaggtttacttgcctcttctagcctatggacactgtctttcactggagttcaagtaactgtctttgaaagaatgcttcgttattctcactgaaaaacagataatggaatagtcttgatctcaggtaactgccatactaaagagactaaaatttgcatcaggaaagaaaggaattccatacctctctgggtaatgtgattggattcacaagctgttaaccaatgaaatgatgcagggtaaattgttaagacaacttcatcttatgaatacaaggtatccttccgacatcctgagagtctgtgataaacatgctttcatacgaacttgacacggtctttgatagagcatctccctttacccctttctagaacttgggtttcactctgtaatattgaaataggagtaaataaacacactcacttaccagatgtgaatgagaaatatggccagaggagatgaactggtgggcgagtagaggctggactctggctaattcagcacagtccaggtgccagttcataagcttgtggactggaaaacctgtctgctgaggctttttgacagcatacctagtcaatgtatcttttcgaatagattgacatcaagacccaggtctctattcatttatatagacatttaactaattgacaaatatttattgagccctatgagctgccaagccctgttctcggcagtgaaaatgaagcactgaattttcttctgtgtcattatagaacgcacattttagtaaaggagtctgacaaacaaataagtatctaatattactagtaggtgaggagaagggggtgacagaggatgagatggttggatggcatcattgactcaatggacgtgagtttgagtaaactccaggagatagtgaaggacagggaagcctggcgtgctgcagtgcatggggtcgccaagacttggacatgcctgagcgactgaacaacatcagcaggtgataaaggcgacaaaggaaaacagaggagggtacgacactagggagtgagaggtggagaggaagagcccacaggcagtcagaagacgggccacgtgaggcccgggcagagtttcagaggcagcaacagcaagcacaagggccctgaactgggtgcccgctgagaatgtcctaggaacagtggtgcttattttcagtagactggagtgttcttggggcaaataaagtcctttctctccaagccaggcttgttacatagaaaggatgccaccatccagaggctgattggtgagcctcatatctgaacaagttgggttagtgtctgacgcatccacctgttcttctgagccataccccatatggtatgtctctggctaaggctgggatgggcaacaacaccttctctttcttggtttttaaactgaggttaggaaacactgggtgaatggtccagcacccgtcagctgggtagtactggcaagttctcccactcgttccctttttgtagacagctgatgcaggtcaggaagcaacagttagaactggacatggaacaacagactggttccaaataggaaaaggagtacgtcaaggctgtatgttgtcaccctgcttatttaacttatatgcagagtacatcatgagaaatgctgggctggaagaagcacaagctggaatcaagattgcccggagaaatatcaataagctcagatatgcagatgacaccacccttatggcggaaagtgaagaggaactcaaaagcctcttcatgaaagtgaaagaggagagtgaaaaagttggcttaaagctcaacattcagaaaactaacatcatggcatctggtcccattactccatagatggggaaacagtggaaacagtgccagactttattttggggtgctccaaaaccactgcaaatggtgattgcagtcatgaaattaaaagacgccttcctccttgaaaggaaagttatgaccaacctagatagcatattgaaaagcagggatattactttgccaacaaaggtccgtctagtcaaggctatggtttttccagtggtcatgtatggatgtaagagttggattgtgaagaaagctgagaattgatgcttttgaactgtggtgttggagaagactcttgagagtcccttggactgcaaggagatccaaccagtccatcctaaaggagatgagtcctgggtgtttgttggaaggactgatgctgaagctgaaactccaatactttggccacctcgtgcgaagagttgactcattggaaaagaccctgatgctgggagggattgggggcaggaggagaaggggacgacagaggatgagatggctggatggcatcaccgactcgatggacatgagtttgagtgaactccgggagttggtgatggacagggaggcctggtgtgctgtgattcatggggctgcaaagagtcggacacaactgagcaactgaactaaactgataacatgcccaaggccacacaggcagaaactgaatagtttttgactgtttcctacatctctctcctgctccctcctctctccctcctgtctctttggtcaggtccactctggttgaaaacaaatttggtggttggcaataaaccacagaaaagaacccgtgttgacaattagtcaaaattaagtctgtcttagagaacaaactcatggttcctggctggggtgggtggggggaacattgggggaaaaggatggttagggagcttgggatggacatctacacactgctatatttaaaatggataaccaacaaggacccactgtatagcacagggaactctgctcagtgttatgtggcagcccgaatgggagcggagtttgaggaaaatggatacatgtatatgtatggctgaatccctttgctgtccacctgaaactatcacaacattgttatctattatactccaatattaaataaaaagtttttaaaaaataattaagtctgtctagtaaagtaagccagaaggaaaaacaccaatacagtatactaatgcatatatatggaatttagaaagatggtaacaataaccctgtgaacgagacagcaaaagagacagtgatgtatagaacagtcttatggactctgtgggagagggagagggtgggaagatttgggagaatggcactgaaacatgtaaaatatcatgtatgaaatgagatgccagtccaggttcgatgcacgatactggacgcttggggctggtgcactgggacgacccagagggatggtatggggagggaggagtgaggagggttcaggatggggaacacatgtatacctgtggtggattcattttgatatttggcaaaactaatacaattatgtaaagtttaaaaattaaataaaattaaaaaataattaagtctgtctttcctaataagagtattaccctttacagccttaattttgggcatatccctgtctcttaatattgctgcaagaactcatatctggtcaggccacttgctctgacctgcctacaagaaaagcatttccacaagcacaatagtcttgcttgtgcttgactcacagtcaatcccacagacgtttcctattagagattctggaacttcaacaggtcacaaaaaaacccacatccttagacattcaatacagatttgcttacagaacccaggagagtatttcctcaaattagagggcgagctaactgatgattccaggaatcaccaaattactcatctcatgacctggttcatgatttatttgaacacataaccacgtattgatgaaggggtattaaggaatgcaccagcctgtttttactattgatgcctccattttatttcagagtatttcatgtggctctcaagtcaacgagtaacatcttacaaagacacacagtcctttttcccccgtcaaagcagttttgcacacatggcatcattttctccgctcggcaacatctggcttcgctgtttccattttaatgaccgggggcttagacgtggcggccgctgcgctgtccactaggggttttcacagacacgacttcatttgatcctctcctcccaccctgcagggccgaaagggtgcccgtcctcccattagttagtctgtctgcggtgacatcccaccaggcaagcctgtctttgcccgagaggtgagataaactaagggtcggggttaggggcatccgcaagacttcggaccggttgccttaccaaggacctccccgcaacaagcccgcctggcaattaagtttagtcgctcagtcttatccgactcctttggaccccatggactgcagcacgtcaggcttccctgtctttcaccatctcctggagcttgcttaaactcatgtccactgagtcggtgatgccatccaaccatctcttcctctgtcgtccccttctcctcccgccttcaatctattagccaggggcatccaccctcccgacccaccaggaggacttcaacttaagcaaagcatcgaatcccgccgcgtgttaatcaagttccagaggccacagcagagcgtcctcggggcaagaacgatctcactgtgctgcgactacgggtctgggctcgcgcccttcgggagcggaggatctgggggttcttcctgctaagaaccctcgagaagggccgccgaaggccctctcctagccgcggccgagtaggggagggggagtgtgttgcggggagtgtcacctcgctcccgagccgccagcgacccagctgctaccgtagcaccatacgggaacccgagactcggaaaccgtttacctctactacaggatttctgccggaccgcgttgctcacaagccccgccccttccgtcgacttttctccataggccccgccccttccgcagccccacccccgttccccccacgtgtgagccctgagaggctggctgggtcaccgcgcgtttgcttccgccaggtctccgggtgtgtggatcccggcgcgccgcccgcttggccatgggggtccccaagaggaaggtctcgggcggccaggacggcgcggctgcccgggcgagcacagccaagcgggcccgcaccgaagagctcacgggcgtgcgcttcaaggctcagctgagggacccgcagggcgcggggccgggtgagtgcagcggggaagagagcgcgagcttgagaggcgatctcccagcttcttctgtctgcgtggggcctccgtgtgcagacgcagcagctcctttctgcagcgagggtcagagcccagcctcccgatttgtagtcgggaaaccgagacctgggtgccggggagtccagggccacgatttgcttgatggtgacagtttccctgcgagtacatgcttcccctgcccgggcagcatctgtcagcaagctctaaaattctttttattgcagttgttaggaaagtgggtaaatgtactcctcattcatcacagcagatacttatggagtcctgactgagtcggaggctttcctcatagctcaatcggtaaagaatctgctgcaatgcaggagacccaggttcgattcttgggtcgggaagatcccctggagaaaggcatggcaacccactccagtattctccatggagaataccatggacagagggttatagtccatgggattgcaagagtcagttcggggctgttcagtgagcctgtttgcagttactgccatggctgtcatctctgttttgcgtagctttgattctccaccactcacactgacccaagaacacgtaataagctatcacaggaagccaccacagggtctgtcagttgaccaagattagtgactgatacgaagtagattctataattcaactttttgaaaagtgtgatcacccttgcacaacttcttgtaatccattagaaagtatttagattatgaggacaaagcacaatcgaattaggctaatatgtggaaacactggcattgtgtcaaaatgaaacagtgacagtgtttctcttaagtgaaaaattaagttcatggccagaatatcctcagtttctagtttgtcttccacagatttttttttaaaggtttgatatctgcaactgctagctagtactaggaagatgatacctgctttagcacagaattacacatttcattcattcatttgttcattagtttttggggaaggaaatggcaacccactccagtattgcctgaaaaatcccatggacagaggagcctggtgggctacagtccaaagggtcacagagttggacatgactgagtgactaagcacatacatttcattcattcatttgttcattatttacaaggggctgttatttgctggggtagggatcaaatggtaagaatcagatgggccctgccatttttagattgaatgtgtaagtgagaacatacagtatttgtctttccctaacttgtttcatttactgccttcagggttcatatagaatgttgcaaaaggtgaagtttcctactgtcttttttttacttttttaattttggctgcactgagtggcatgtgggatcttacgattgaacctgcacctcttgcagtggaagcttggagtcttaaccactggaccaccaggaaagtccccagtgtccttcttttttaaaggctgaataatatcccattgtgtgtatttctttcctttgttttttttgatatggacaagtttaaagcatttttattttgctttagttatctatttgttcactcatttatttatgtatggctgcaccgtacagcgtgtgccagctgagttccccggccaaggatcgaacccatgccccctgcagtggaagcacagagtcttaaccagtagaccaccagggtagtccctgatgtggaccctttttaaagtctttattgaatttgttgcaatattgtttctgttttctgttttgtgtttttttggccaggaggcctctgagatcttggctccttgaccaggggttgagacctgcccctctgcattggaaggcgaagttttaaccactggaagtcccttttatgtgtatttctgtgtatagatataccacattttctttatccattattcccccttcagttgatgggcggtggggatggagagcagggttacattgataaagacccagaggatgcccaggagcatcgaatagtaacccatcaggaggattcctgcagcaggaagggttctgctctcagccagtgcctttgaaagatgctccccatgacttaaggacatgtcctcttgatctccctgtctccaccctgctcctctgttccatcttgtcacgggcggcttccagtcacctggctatttcctgccagcaatctccctctgtcaccgtagcaccagggattgtttctaaagagactgtccttattaacatctgaccctgcctctcatttcagccctggaggcatttgtttccgctgctaagaagctcccccgagaagatgtgtacgatgttgtggaggggtacatcaagatttctgtggagtgtgccgagattttccagctcctgagtggggagaagcgccctgaaagtgaagtacgcttttccttacctggcctgatggggagaagcaaaagtcagtgctactgttgtgttagggcttccctggtggctcagtggtaaagagtccacccgccaagcaggagacccaagttcgatccctgggtgggaaagatccccttgagaaagaaatggcaacccactccagtattctagcctggaaaatcccatggacagaagagcctggtgggctacagtccacggggtcgcaaaagagttggacacaactgagcgactaaataacaacaactattacgttaagcttgatgaaaagaaatgtgatataaatctccaaaattaccagtagaaagttaccagctttctactgaaaatgatgttttgtgcctgggctgtagagatacattcattttttgcattgtaacctttgaaagcctttagaggaaagtgctaacttgttactggtgaataatagcagaaggaaggatcatagattcttgtctaaacacacttggtttctgaatggtttgctttaatggaagggaaataggtaaagactgtgtgtcccaggtagagatgtatattgagttgtctgttgttttctgcttccaaagaaggtcagaatttgaggcgtttatgaacctgttgaagtctcaggattattgctgtaaggctgtagacctgaatatccccaaagcagtgaggtggaatcattactagaaatttctcttttaatttcatttggtttaattgtaagcaagctgttctctatttagctagactcttggagcaaggctaattccaaactcagggcctggcagatctctgtgtctgattcgggatctggcaggttgaaaaatttaaacctgcaggtgactgtggctaagacaaatgtctgtagaggcggaaaagaaaaggagatgatttgtaagcacctcggttctgtctttgcagatgcttttagtatttcaagttttcgaggccatattattgcggacagccagtgacctttcccattttcacgtggtggggaccaacatcgtgaagaagctaatgaataaccacatgaagctcatctgtgagtccctgtacgcctcgggttacaggtacgttggccgcctgtacgtggcaggactggccttggacttggtcagcgttcagctctccacgagggcacttgaccttttctgtaccgcccgcagagctgagctgtttccaaggctatggcagagtccctcctcctcctgttgactgtcccctcgctgtcaccgactcctctgctgcttcgggtccctctgctcccgccctgccactccccctgtggtctagggaacaccccagacctccttaacgctgcctgtccttttaaccctcatctcctaggtcttcgcaaactccttccctctccaccttcatagccttgcggaggtgtcatctcagggaggccctatctgaccatcccattatggcacagctgaatgtgtgccataatatccatagccatctcctgacccactgtctccctccactgggatgcagggtgcatggcggtggggccttgacggtctcgtaaattgctgttttcccagcacttaaatagggtgtggtaggtgctcagtcaccgcggattctgggtgacctcccgcagggtggcaagccgccaggcacttgcatctagagatgtcctctgtgcagaagtcttcccctggctggcactgggtgggagtggggtccagctccatgatgatttactggaaacagacatgtccgtcttctctctaccttcatcttgagttcttggattgtcctcagactcaggtttttagctttctttgaagattttgttagggtattttttttcttaaagaaagggcatgtctccgtgtttccttcctcctggtttctggtgtggggccagcagaccgcacagagaggttgcagctggctcgaggcgagggggcctttgtggtcctgccgtcacgacaccaggtcccgcttgtcctgaacaggatggctcgagcctgcctgaacctgatggctgccatggtgacccagggtcccgaggccgccagggacgtctgcagccattttgatttgaataagaagaccttgtacaccctggtgaccaagagggatccaaaggtgaggagtgtctcatgtgtttccccctgccctgagtgtttcctttccttctagggggctgcggtggttcctgggtcctcctccctctggcctcggtcctcacgtagatggagtgggaggcctctgtgtgaaaggtgtgtgcctcggcagccactttgagcctgtgaggaagggcggcctcgccccggctggtggtgggggcccggtcgcctggtggggcctgagtgacagggacgtgaggccagctcccctggggctcagcgtggcggggcctctctggcccgtgaggatggtgcagctggcgggcgtcttcccagagcggcggtggtggtctccatgggcctcacggggtggtgctcgtggtggtcctcccatgcttgtcccgtccactgtgtggaaaagcccttgagaagccacgccagtgagctcatcagaaacgacatttatagctttttaaaaaaataattattatttattctttgctttatttgtgactgtgctgggtcttcattgctctgcgcgcttttctctagttgtggcacgcaggggctgctctccagctgcggtgtgagggcctccccctgccgtggcctctccgcctgtggagcacaggccctaggcacacggatgtcagtcgctgtggctctctgggtgcagctcccgggctctagagcacaggttcagtagttagtggcacaggctcagttgctctgtgacatgtgggaatcttcctggatcgaggattgaacccgtgtctcctgcgtttggcaggcggattctttaccacagagccaccagggaagcctgacgtttgtggctttttaatatgttccttgtgcctcccagttagaagtcttaacaatgggtaggggctggattgtgccaaagagaatcgaagtgtgaacggttggttgtgagagttgtctaaagaagaaaggttttctaggagctccagaagtttcccttgggttcgaaaggatcttgagggaaaagcacgagtttcagaacacgtgagccagagcatgggcacccttccaacccctgtgctagctgtgggtggtcgaggtgccccttcctctttgcagggtctgcccttcccactgaggttcccatgtggcgctagtggtaaaggatctgcctgccagggcaggagacgtgggttcaatccctgggttgggaagatccccttgagaagggcatgatagcccactccagtgttcttgcctggagaatccccatggacagaggagcctggcaggttacagtccatggagtctcaaagagtcggacgtgactgaagcaacttaacacacacacaccctcactgctggctccgtcccccacgcccccttccttggcattggcatcaggtgacagaggcccacctctgtctgcccgggtggaggagccacactagaacaagtgacttctgcagccaggcgtgacctccttctccggctcttcctaggaaataaagagtttctatgctgccaggtaataactagactgaaggtgaatcacagtaacaatagcgttgaaggtttttctggaataatgattcaggttttctctgaggaaaaacttccaggtcttcgtgtttcatggatatactatagtcggtgtgttcgaagttccacttaatgagtgacggctcctggcatctgaacgtgtgtctgacaaaaagaaggtgtgtgctatccacccccgagggcagacctggctctctggtcttccctggccatcagcctggcagtaattacctgtcagaatcccttccctttcccgccctcagtcttggcctcaacccacccttccatcttacgtaaagtgcacgtcagcagacaggccatccggaccgcatagcatgggaaagcccagtccttgtccgggtccggctgcttcagctcagggcctccacaagtcattttccctcttgatctggaaaacgggagttaactgtagaaatgaaagtatttttgctttgcttaatcatccgtatcaagtgtcttacatactttgtgcgtgctgtgctaagtcacttccgtcctgtccaactctttgcgaccccacggactctagcccgccaggctcctctgtccgtggggttctctaggcaagaacactggagtgggttgccatgcccgcctgcaggggatcttcccaacccagggatcgagctcacgcctctcacgtcttgcaggtggggttctttaccactggggctaccctctgcattggaagtgtggaatcttagtcactggaccaccagggaagtccgaaactttgtatattgtaggaaatagtttctagacagtaaaaaagtttttttcatatgggaagtgtcaggaacattcaaaaatagacatcagcacagtgacttcctatgtccctgtcatccaacttcagatgctgtcatcctttcctgcctttaagttttggggcagacagtcaattacagcatgtgtgtgtgtgtgtgtgtgtgtgtgtgtgtttgtatgtgtgtgtgtgtgtgtatgctaagtcgcttcaatcagacagagtcatgtccaactctttgcagccctgttgactataacccgccaggttccactgtccgtgagattgggttgccatgtcctcctccaggggaatcttcccgacccagggatcgaaccagctctcttgcttctcctgcgttggcaggcgggttctttaccactagcgccacctgggacgcccctcttacagcacatcgcacatatatttcgactataaatattcagtatctcgaacagaaagcaacattttagaaaacaaaaccatggtgccatcatcatacttaacactgtgaataaccatcgtctgatgcccagttcagtctcagcttttcccccactgtctcagaaacatctgtaccctctgtggttcaaatcaggatccacacagggctacagggggtgttctgctgatgcgtttcttaaatctctccagatctttgaattttctgcttttctcccactttttttttttttaagtcatttagttgttgaagaagctaagagagatatttcttttcaatgtttttaacattttggagggagttattcaagcctcttgaagaaagaggactatgaatattttttctcatccaaagaaagcattgttaaaagtcctgtgccaaagagctgttttaccaaatatgttttggtctatttcagacagtgttttgcagaacacgccgtcgagttcaggatgttttctccctggggtaacagccccgtgaagtcagagtgtaggaatgagggcaggcgtgtgtggccttcttgcctttgatggagtttgctggagacgcagggcggcagctgggggcagcgaggggctgtggtcagggggacaaggcctggcagcggctgctggagaatgaacagccaaggctgtgtctcaggggtcttgttttccaccgtgtcaggaatctgaactttggggttctctgggacataaaagatggatgccagcgggtgagaactaacttccgtttcagttcaaaatccattgctggcagcacccgtgagagggtctctgctgtgctcacatgggatagaaagacctagaatggcagttcgggaccagcactccagagccctgattcccaggacttcagtggacagagaaccccaaacatcgggagcctttccaactcaagggggaaggatgaaacctaatttcattttaccaggcaagttttagcattttgccagaattcttttcgagtttaaggcgtgtgaagaccaggataagtgaactgtgcttgaatcaggtggcacgtaggtttgaacggtgaggcatccagatggcttagaagcagtggtcgcttgaagcagttactgaggacagggatagtatccgagtcacctctgtgtcctcccagcctgaggttatgacaccttgagtgtcactggtgatgtattaacgtagagttggtgaatgaaggcccagagcattgctgacactgacggagtcagagtttagcttattttcaggacttgaagggatcattgtacccaaaccacgtactgtgaagaggcccacaggttggtccccagaacgagaggatagtttggggctctcagtgtatttgaaataaagcagcccaggtcttactgaagtgtgtgctgtgctgtggacagagatgagctcagtaaatgcgaggactttgcaaggcctccactcggatgttacagagcagggttgaatgcacattcttttctccagaagaaacagccaatacaacaagacagttaattttgtactcagaggcctaaatggtgccacgtatggggcttgcaccttgagaaaaagtggcatggagctgccaggggagcgctgagagggaggagcctttctgtaggcagacgcgaggtcgagtaggaagtggtgtgtgtgtgtgcaggtatttcataccatcccagtcccagtactttctcacttagtagtggtataacctcaagggaggggctcccctggtggctcagctgctgaagagtccgccggcaatgtgggagacctgggtgtcatccccgggttgggaagatccctggagaagggaggggcaacccgctccagtgttcttcctggagagtccgagggacagaggagcctggcgggctacggtccatggggccgcagagtcagacccgactaagcgacacacacggaagcttaagtgaggtttttaaaaccccagtttccccatctataagataggtgtgctgggtgactctacctaagattcttattgtaactgagaaaaccgatatgcacctggcagggagcctggcagtcacgagtgctcaggaaacgttactgataccatgctcctcgccatcaccatcgccattcctcatccacatcctcatccgggccgtcaccaccagcacgctcctcacctcctcaccctcctcacctcctcaccctcctcacctcctcaccctcctcaccctcctcaccctcctcacctcctcaccctcctcaccctcctcacctcctcacccccttcacccccctcactcctcacccccttcaccccctacacccccctcaccccctacacccccctcacccccttcaccctcctcacccccctcaccctcctcaccaccctcaccctcctcaccatcactactgccaccactaagtgaatgggactccttggaaggtggagactcctcagtttctgtaggcattgaaggcagtggttctccatgatgttaacttatgtcttatcttcaaattaaagttagtttgtaataactgaactcgggaaatgctgtcagggtgagcagtggaggctctgagcccgtgtgcttgttcaggtccagctgacacgtgctgtgtgtgaacatatgccctggattctttgggtgtaaaacaggaatgtgagacacaggcttgccttaaagctactgagaggagagactggtgaagtggccctcgtggccgctcctgaggggctggctgtcggtcatggcctttgggccctggttgaggatgctgtcctgggtccagctgacacccccgcgggacagtgcagactgcagtcctgggaaggccatgctgcgtgtgtaatgtggcctcatctgtgtgtctgctgtgaatgtctaacatctaataaaaaccaaacatcacctcatgggtgtctcatcaaaagcagcaccagcctttccatcatctatggattttcgaaaacagagacctattatttcatgacatgagagcagatggtgtgtagacaggccaagcatcttctgctatacaccagagctgtccctgaactaaaaatttgtgtgtcttacaggcagggaaggggagacctgtgctttggtgtttagagagggcttgaaagaagagtaggagcttgagagggaaagagcaaaagaaaaacccttggtttccataaagagatgaccagtggttctagacgtcgaccctctgacagtaccagcctggaggaccctgtgatagggggatgagcgggatgtggggggacagcctcgtgttcctgcttccttggggggggggtgtgtgtgcgtgtgcgtgcgcgtgtgcgtgtaaacacccgtgtgacacgatctcctttgcccccagggagtacatgatgtccggctggcctacattcagttcgccctttcctttctgattgccggtgatgacagcacgatcacgcaagtgctggagttgaaaggtaggagggcctcgttgtcttggggcccagcctccctgtgattgttctgagcgtttaatgggttaacaaaggtcagccgcctctgtggctgctttgcacacaggaataaggggtgtgtgtggagagactttggttaccgtggcttgaaagccgctggtcagtgcagacagaagggtccctgttgcactagctgggtgctgagtgggcctaacggaggagaaatgcaaacttcagttcagttcagttcagtcgctcagtcgtgtccaactctttgcgaccccgtggactacagcacgaaaataagggaggctttacagttccagaaaggacgcagattcatagccctggctaccgagctgctcttagtagttgtgttttttttaatgcctggtgtgagcaggatatcagaaatcgagcttcagagaattccggctggtgccggtctccctagagtgaggcttggcatggtttcatccattagggccaccagcttttttcgcaagaccatggatggcagcgcagagagggtcgttgtccagtgagacccccggggtcaagccctgtctgtgggtgaggagtggctgccatctcagctggggccctgagactcgtgggaggagaagagcatggggcctgcaaccgtttccccccctcccccagcatggagacctgggtcccctccagggcaggctgctgagaccactcacgagcagctgcgggtacgggtccctggaggtggtcagcccggggccgggtggctgcccagaccacagccccgtggaggacacacctccttcccgtggtgtcgtgcccaggtcctgcttgtggccagcctgcgtgggatgccctctgcttccagggctgggcatttcttcagaatcttcccctgcgtcttctcagtgtctggcttttattaagcagaggacactgattttggtgtcatccgtccacactgctaaaggagcaaggatgtacttctggtaaagtttcagcagggcagctgagctaggccagccattccacgtccagccgtttatcctaagggaataattaaggtgttgagtagaggttttgttaggggatatctttttctattagctgaaaatcggactccttactacccaccagcaagggactgagcaaattgagcactggtcataaggaggaatgcaggtatcaaaaaggatatagaaatatacttactgataccagattttttaagggtataggattaggtgtaactccgttataaaactggtaaaatatgatcccattttactaaatgtttaacagaatgtggacataccagaaggttaacagtcaactgggaaccagacattactcaatatgaacttttgggtggtggtgttatggttgattttaagtttctatccggtattttctgattttttttttcttttaagaataatgaatttgcctttgaagaaattatatgtgctcgtgaagaatgtatagagcaagagaaattgtaatgggtttgttgctttttaccggtgtcaccagtatgttagtaatgccagagcatcaagctatggaagactgagtccttggggagataaagcaaataaatcagtccaattctacggccagtcaataaagtgacaactgtcattttattttattttttaaataaatttatttattttaattggaggttaattactttataatattgtattggttttgccatacatcaacatgaatccgccacaggtatacacgtgttccccatcctgaacccccctccctccaccatccctctgggtcgtcccagtgcaccagctccaagcaaccagtatcatgcatcaaacttggactggcgattcgtttcatatatgatattatgcatgtttcaatgccattctcccaaatcatcccaccctctccctctcccacagagtccaaaagactgttctatatatctgtgtctcttgaaactgtcattttaaatacatctctgaactggtctaagtgaagagtgaaactttggaaaactaatcataccatatgtgctctctcaaaccattagtattaactttactgaagtcaatgtgaaaaaagaaagggaagatagaaccaaagaactgttgaacttgagtggttcactcattgtattgcttttagatatttatctcctatgtcacaaaaatagtttttcctgctgtgaacttgtgtaattaaaaaagacaaaacctgaaaaaaaacagggggagggggcaagtcaatggcattgtttgccgtaccattttaagaagtaatgctctctcatctgttcccattcaaagtatttttgaatctaacgctttgcaactttttactttcagaatttattccttgcatttttagctcaggcatcaaggaagataggatctccaccatcagtatcctgttgtccacactgaaaacaaaggtacgtgtttggtgatcggcgttcttgtcgtgtgtttgttccggtgttttttggcaggacttcagagccatgacctcataggtgatgcgggttgtcgtgtgggttggatgggaaactgtttcttaagcaagaacttggtggtggtgagcgatcctgaaggttacagctgccacttcttacaagaggagaagacctgctacccgcttcccccaccccctaccccattccacaggaagccactggggtgactgcgagctgcaaatgacagcccttcttcccgtacacacctagcgtgctgtgttgtgttatataataacacaaaatgtcattttgtgtcatcttccatattctgccttacataagcatcttgcggaaatctgaaaacttgctgaaaggatcgctgtctttgacacagaagccccttctgtgatccatgagaaaaactctgtgaccctccccaaataataaaaagttgtccaaaggctgtgagctggcagcccatgtgaaaaggggctcatgagcacatagcatctagagcttctcagcttgggcacagttctgtcccccacgggccatctggcaagttttggttgtcataaccggagaaatgtgactggcatctggtgagcagagaccaaggtcgagcaaccactgtaggctgctcagcgtcctgtagtgcagaaggcagcctctcacaacagttatttgtccccagatgtcagtagtcctgagattgaaaaagttcctggattcaaagcagagcaagtcatgagattacaggttttttcacctaccaagttggccttgacttttcagacctgatactcagcaccagcaaagaatcaggtacttccctggaggaagtgttatggcccctctggaagacagcaggtctggcagtgtgtatgtcagaggtcttgaaaatgtgtatcaacctggaggcgggggtttggggagtcgcctcaggatcacccagggaatggatttgaaaaaactcataagccctcagagatccgggctgggggctaggttgggaggagctgagaacttgtgcaccattccaagaacataggtaggcacgcagtgcaggctgctgctcgtgggaacagcctgatcgtaccacttggggaatgggtacatgacttacggtcactcctaggacagagtgatgatcagccctccaaaatgatgttctaaaggatttttaccgatgtggagacagttcatgctacataaataaagcaggtacaaagctatatataatttcaaagaagttaaaaaaacccaaaccccaataaaaacccaatacacttaacatatacacatgtatattatatactttgtgtgtgttgtggggaggggcagaggctgaaaggaaatataccaaattgtaagctgttggtgtccaagaaggtgacaatattgatgaattttgttttcctctttacattttttcctttttctggctaagtgttctgccacaagtctatattatttttataatgatgaaatccaacatgttctaaaagtcggtttccttgaaagccatttgttctattgttttcaggtagttcacaataaaaatatcacaaaaacccagaaggtgcgtttcttcactggccaagtgctgaaccacatagcatctctctacagctggaaggggattgtcgacgtgagcctggacagcgtcgaggtacagtctctggggttcgcttggcatcactgttagcgtgagatacccagagctgatggctcaagtggtgtagaatctgcctgtaatccaggaggctcaggagacgcgggtttgatccctgggttgggaagatctgaaggaggaaatggccgtccactctagtatacttgcctgggaaatcccatggacagaggaggctgacaggccacagtccctgggatcacaaggagtccgacacgactgagcatgcatgctcacacaaaaacaggatctatgcatacacctgccttaaaaaataagtccccctgtttgatctgtttcttttggcctatggttatattaattatctacctagggacaatatgactcttgtaattaaagtaaaattttttctaatctccgaggtatcatattcaactttttttgtctttttctttaataagcaaacttattccatgtagctgcagggcgtcttcattttccctgcagtgtttgcgtggtagccttagagggtggattcccgctctctccctccttacttacctctcctctcccatctgttcttttcacatctttccagtcatcagagtttcaaggcctgttgcttctgctttagggccctggaatctagggagcgtcagcttcctcacccgctgacgagaatagtttgctctgtgtgtgtgctcagtcactcagtcatgtctgcttcttcgtggccccatggactgtagcccgtcaggctcctctccccattggatttcccaggcaagaatactggttgctgctgctaagtcgcttcagtcgtgtccgactgtgtgaccccatagacagcagcccaccaggctcccccgtccctgggattctccaggcaagaacactggagtgggttgccatttccttctccagtgcatgaaagtgaaaagtgcaagtgaagtcgctcagtcatgtctcatgactcctagcgaccccatggactgcagcctaacaggctcctccgtccatgggatttgccaggcaagagtactggagtggaatgccattgccttctctgaagaatactggggtcggttgctatttcctactccagggtgtcttccagacccaggaatcgaacccccatctcttgcctctcctgcgtcggcaggtgggttctttaccactagtgccacctgggaaacagcaagtactagataagaagagtcactctcatgaggacctaaggcctccgcacctttgaattttccttattttgatctttctcagggcgtttctgaacatgaacttggccagagtagtgaaggctcagacttctgttaactctataatagttaacctttcaagagcccactgttgtacccctttttatctccacgacctgcctgtgtccttgttctgctcatgttttgtatgttccataaccaggaagccccagagacttcagaagaacactcccaattgtggaattttattcaaaagagcaagagaaactaagtcattcataagcttgtttgaaaatacaggtttaaacttgcccctctcaagagttttgtttttgctttctggctgcactgtgaggcttatgaggtcttaattccctgaccagggattgaacctgcaccctggcagtgaaagtgcagagtcctaaccacaggaccaccagggcagtccccaacggctctatcgcataggtgaggacacggagacttggggcattaagcgatgctctcgtagtctggtgtccagactccatcctgaacctctcctggggcctgttaagatttgcctcgttagaatgaaagatgttcctgtcatctaggaaattctgaaggattcaggatttccatgtgagatgttccacttgcccccatcactcagaaaactgcaagggttttaggagctctgtgccaggaacggggcaacaaccaaacgtttccgtcttctgctgcagtatcatgatgcaaaagcaagaacaagcttaaaaaaagtaaagcatgtgctgtaaacagagagtctttgctactggggtcccaagcctgacctgctctgtacctcctgtctcggtgctgacctcagcgtctcatccacagtttgctccttcgtcgaaaggatgcagtcctgtctgcccggccaggctcatggggctgcactaagaagtactgtaaagtgctcagagacaatcagagacgacagaaaatctcagaagttacctgtagtttcttgtggttccagcagccccctgtttgttcaactttaaaaaggaaaattttaattcagtttatttaaactgaaaaacaaactaacaaacaaaaaaacccacagttgacccattctccccagtccctagaccgccatatctgacagctaccaatctgctctgtgaggttttttaaaaaaattattattgttttatttgtttatcttgttcagattccacatatcagaggacttttaagttttgattggtatttctcctttttgtgcagttttgtttttgaattatcattgctgttgttcagtcactaactcatgtccgactctttgtgacctcatggacctcagcacgccagattcctctgtcctccactctctcccggagtttgctcacattcatgtccattgagtcggtgatgccatccaaccatctcatcctctgtcgtccccttcttcttttgctttcagtctctcccagtatcagggtcttttccagtgagtcagctcttcgcatcaggtggctaaagtattggaacttgaacatgagtccttccaatgaatattcagggttgatttcctttaggattgactgatttgatctccttgctgtacaagggactctcaagagtcttctctagcaccacagttctaccaagtgtttaatttaaaatgttttctgatttgcttttaatctgaggcatgtgcttttgtccagcttttaccctgtaattgttagtaaggcatgtgaagcttggatggtcattgagtgtctttgaaactctcatagacttctgctaaagacgcagggaagaccatggtgcgggagcttgttcataacttcctgatggatctatgttgttcgctcaagcatgggattaatttttacgacgcatctctcggtaccttgggcaggtaaggctggagcctgtgtgcatcctgagtgtggttctcagaggccatcatatccatgacttcctgtggggatctgtcaagtgatagaagtataaggggttagaactagcgttttagatgatacctgactcattttgggggtgaacttggaataggacgcagacggttcctgttcgttgtgggcactcagggcagagtctcaggggagttgactcagacacacagtgtgagatgtcgcacccaggagggcgctgtgtccacttggggacagtgcaccagatgaacctgagaataaatccagagacaaggggccctcccgggggcctccccgcagtgcttggtgactgccgttgttaccccagttttgcagatgagggaaaggggcccgcagaggtcaggtcactccccctgtaagtggcggagctcaggttggaacctgggaggtcctggttcccagcccacacccttgacggccacacagcccccctctgcccagagccggctgcgagtgagtcaggctgtcagagtttccttcttgccttttatttcatattgcaccattacgatagcatttcattgtaaggaagcatgaagtccacagctaatggtttcgattatgttcttttggacattctctgtaaacctatgatacatatctgtgttaatttttaaaccaaaataccctattgttagatatatcgttcgtcaatctgcttttttcccatttgacagtaaaaatatcggacatattttctggtcatcacgagtgaccctccgttctatctccttgacattttattacaagaatagagttgatttgctttggtttccaccagtcaggcaatgactgattccctcataatgggattaacctagtgagaatttttctccctgtttgtggctttaaacttgtttagattctgtagttattatgcattaacttgccatgtcatttctaaatctttcaactttgttttggtgatattgtagcttttctgtcatcagtgagagaaaacttgttttcttgctgagatgtaagagcagacttttacagtctaatataaacatgctgaaaaatgccttttttctgatgaaggagacccataaagtagatgatcatttcatgagcatattgaatcaacgtgtggtcgtgggtctgtttaaataagcggtggtttatgtaaaatttttcagctatgggccaaaggcaaatatttgtgcttaggagagaggaaggggttttgtttgtggggtgttaatggaaagcgttgagaaaattgaaatgtctggcttcccagtggtcgtcaagctcctttgtgtgctgctggtctccgtgcagatgtcgccacgtcagagaggccttccctggcaactcttcctaaagatagaccttccactctcaccgtccttttgcctggctcttgcttctgatggcgacttatcaccactttgcatatttgtttgcttgttcattatctgataggcaagaattggtgagaacagaggctagtcggtttttgttttcgtttttatttcatttttggctgtgctgggtctttgttgctgggtgacggctttctctagttgtggtgcgtgggcttctcattgcggggtcttgttgtggagcttgggctcttaagtacgagagcttcagtagtcgtggtgcatggactcagttgctccacggcatgtgggaccttcctggaccagggatcaaacccacatcccctgcgttgatgggtcaattcttaaccactggaccaccaaagaggtcctggctagtctgttttgaatccccagagtctaggacagtgcacatagggaggcattttagcataggccaggcttggccaacttttcctctaaaggtccaggtagttaagtatgtcaggctctgtgtgctatgctgtccctactgtggccactcagtaggccattgtggtacccaagcagccacgacatgaataaacaagtgggtgtaactgtgttccaataaagctttattgacaaaggcaggtggcgggccagagcttgctgagccctgccgtggaggttcagagaacagtttctggagtgcctcagagacctcagcaggttattcctcttctttgccagtattgcctcatctgtttaaaaaataaaaaagagagagatacaattagcacgcacctcagagagtgtgtggtaactgcttagagcagtatctggcacacactggaaattttgtaaatgttgttcattttattacatcgttgattaagattgtgtgtgtgcgcgccatatttttggcatgctttgcagatttaacgttctgtgcatttgaaagcacaaagtgtgttttgctcatgaaattttcctgttaagaatgttaagctttttaaaggatagctttctgatcaaaattactctctaattcaaattttgaaaaatctttattatctgtaaagtatcatattgcatcttagttttggtgagtttttaaggggctccaaaacccatggtcccacaagccatcaacatgacacgccagtgaggccgattttgagttttttcctgggcattatgacttccagggacaagcttgatacaaaaatgtttctggggataaaacccatttaactgcatagatcctgggctaggtgcccaggtttgtgcaggttttaagtctgtaagttttcctgtttttatcatcttacatctttgaaaactgcccactttgagacaagtttcaagtgttttcatatagtagatagccactgccccacactaacttcttttggctgctaagtgaaggtgtaggaatttgaaataagctagaaacaggggaaacagaagacctgtagaaggactctgtgccacttggctaagttctagaaataattttatggcactctggactgtggcatttcacgagcacttcatggggaaaaagtgtaatctttttatttttgtttatgattttatttatgtatgtattatatttttggctgtgctgagtcttcgttgctgcacacaggctttctctagttgcggtgcgagggcttggcgtcacagtggcttctcttctgtggagcttgggctctagggtgcgcaggcttagcagttgaggtacacaggcttagttgctccatggcatgtgggaacttcccagaccagggatcgaacccacgtcccctgcattggcagacggattctttacctctgaaccaccagggagacccaacgtaatctttttaaaaatgcatgcctttgtatgttttacttaatgtgcacatacgtcttcatatacgtgctttttcacgtgtagttggaggatgtgaaagagaaagtcactcagtggtggccaactctttgtgaccccatggactatccagtccatggaattctccaggccagaatactgaggtgggtagcctttcccttctccaggggatcttcctgacccagaaattgaaccggggtctcctgcattgcaggtggattctttaccatctgagctatcagggaagcccgtagttggaggaaagacgtcagtgaaacctcaaaaggaaatttttaaattgtttttatgctgtgggttcagagagaaagggtttcttccttttctctgaaagtcagttgaacttgagtgagggaaggagaggtgggaaacaggacaaaggagagactttttttagctattcaaaagtagggaagtgagacgtccctggtggtccagtggttaagaccctgtgcttccaacacagggggcatggatgtgatccctggtgggggaagtcccgcaggctgaagaagtacaggagtgaagttcaggccctttgctggagagcaggaaccccacagaccatgaaaacctctcactctatgctgtgagggaaactgaccggaagtgaaattgcccatcactgagtcacaacagaaaacgctgtgtttactcgcgggttccaaggacctgccccgtcatcctgagtgctcggtgtgttgtgaaaaccccccactcacccctctctcttctgtctttctgtgacagaggaggaaacctgactctcctgcacttcctgctgggtttgaaaaccgcagcggacgatgagctggtcgctgaactggtggtgaacattctgaaagtgtgcccggacctactgaacaagtacttcaaggaagtgacgttttcctttctcccaaggctgaagtccacctggtcaaataacatcagactgctaaacaaggtgacgacccctgcattttgaagtctgcctcgtggggtcgtgggtgaagtgtgagaagttggggtggcgaggatgggaggttgggtgacatcctgataaactgcaggatcagaaacttctttcagccgtccttccggcatatttttgttgtttttcagtcgctcagttgtgtctgactctgcgatcccatggactgcagcgcaccaggcttccctgtccttcactatctccccgagtttgcttaaactcatgtccattgagtccgtgatggcatccagccatctcatcctctgtcgcccccttctcctcttgccctcaatctttcccagtgtcagggtcttttccagtgagttggctcttcgcatcaggcggccaaagtattggagctttaagcttcagcatcagtcctagatgatgttaattcagtgtctttttcttctagggacattttacttttcactgagctgcattctgaggtttatgctgctgaatctgttaagccaatttcattttcttcatctagatttcacttcaagtgtgatctcaatgagtttagccacagttgggctagaattagcaaaatgcctgactgtgaaatgcaagccaaggagcacggctatttaaagattgccatttcaagttcttagaacaatttgaaataagctgtgtcttggtggtctgtcttgtggatatgagtaaatttccatctgatcatgggtgtcagcctcccctcgtttaccagtggaagtacctgccacaagtccttccattcaccatcgccccttctctcagccttatggtctgactcatggtaacatggggcctcctaggtggctcagtgggtaaagaacccacctgccaatgcaggagacccaggaaactcaggtttgatccctgggttgggaagatcccctggagaaggaaatggcaacccagtccagtattcttgcctggagaatcccatggaaagaggagcctggcaggctatagtttatggggttgcagagtcggacacaactgagtgactgagcacgcagtgatgacacacctggaattatttttttgtgccttgacttgggcaatgggttatctgcaaaacaaacttagtccatcgttttccttgagcacctgtgtgtgcggtccgcctgtgtgctggggacaagaaggaggcgctctgtccccgactttggtgatggtgtcaccgtggccaccgcccctgttgggagctgccctggccgctctctggagtgggacggggaggggcaggtgcatggccgctgcagattggacggtagtcttgccgtctctaggactccctagtctcaaggctagagtctgccttccagccttgcagtccgagggaaacccccctcattgaggtccagtgttgtcatctgtaaatatgttttgccttgatataaaatatctctaccgcaaagggttgtcatgaagtgctaaaaagccgacataatttgccaggtgctgtacctggggagtaagtcatcccgttgtgacctgtttgccatcagaggttttaacaggctccccaaaccaccggtcaaactctgctttgacggtcactgcccccagtaatagtcttatggtctctaaccagtggaatcgggggtcgacgttccagacgctgttccttgtggcgagccctgggcctttgttactgtcgttgtttccccagagcagcttcactcttgagagcctcccgttagactcaggtttggaagttaacttctctgttgtccctttcccagatctacgctgcccagccggacatctcccgggcgtttcagacccgagagttcatcccgctgcctcggctcctggccatggtgatggtgaccaccgcgcctctggtgtgcaacaagaccatgttcacgcaggcgctgaatgtgagtggggaccctgcctccagaccctcccgctcaccccccggccatgcctgccactgtgctgagaatactggcctatgtgtattgggtcgtcttttgtcagtgcttccggggtttcccgtgtgtcccctcgcctgggaacggggccctggggcccaaggcacatacctgcctttctgcagcactgagcgggctgcaggatcctgtgtggctctgggcctttgtcgatagggggcgggggggagcagggggtggaatcagaggagaggacgtgtgctcatctgcagcccagtgtcacgcattgaagtctcattacttgaggatctttggacagagtgggcctgacatctgcctggcaaaccctttcttctgagctttaaatgaatagtgctaactttcctggggaacattgaggcccagctgtttcaggagtttggggaggacatgttcatggaaaaacttgatccttagattctgtgtcatcgtttatcataaagctccaagtcccagcagaagccatgttgtgaggggcccatgccttgttcaccgtagcatcatggccttagccaaacctgccatgagttgttagcacatggatcctgagcttcccaggtggcgctggtggtaaagaacccgcttgctaatgcaggagaccgtgagtagacgcgggttcagcccctgggttgagaagatcctctggaggagggcatggcaacccactcctgtatcatgcctgaagaatccccaaggacagaggagccttgctgggcatggcccatagtgttggacagagtcagacacgactgaagcaaattaacacgcacacatgcacgcatgggttctgggtcctgccaacccctcataaacctgggttgcctcaagacccacccggcagaggccaggtgttcagagcgatgcagggcttggggcgtcccctgggcgggtggagtccccgtgtttcaggcaggctggttggggtgtgagcacagaagaccagggtccgccgcggtgggtcacaaagcgtgggttggacccggtgtccatggggcatttgccgtaaagtggccccaactcctcggattgtactgtgggatgagaggtttttttgctcccgtccagggatggtgctgagagagagcggtagggcatgtggagtggacagaagaggcctgggtgggacctggcaggatggcttgtttgctctggtggccaaatcccagaaccagagttaggacccagctagcttgcccatctgttttgtgagacacaaaatagtttatcccaagagacttgcaaaaaagtggagttgagagggggatgtctgatgctgcctcttgtgggtgggaggtgatggctggctgcatttcctctccactttgagccgaccccagtctgtccccggcggcctgggatgtcaaaggctgtctcactcccaggacagaggagttgtgcccctggagtgttcatgccccgcatggggcggccttgggctggggtagaggacacgtcttcctctcctcctgaggtcaccgtcctcctctgcaggcccggggccagcaaaggggaagctgaggctctgtctccctgtccgtggcccttccccagctgtacctgtgttcacgtgagtgacacagcgacaggtgtgtctcgggggtggagtgaggagtgtgtgtgtgcaggttgtcgagtgacattttccttctgttcattacagttttatctataaaattttaatagcatagattttagaaccagaaagaaaagagtgagctcgttttacaaatgggaaattagagagctgttcggaaataaggcctcaggctgttggccaagcttcgtgctccaagccagcggatatacacattgagcactcatttccgtcctgcctttgaattgatgacggggtgggagtggttattggttcagggcatttaacgtagcccttcttgagtgtacaacatctatataaaatgagacaccagctgattggaatgcggggggcctggggtgttattagactgaaggtccatcagaaaaccttgttaattctacttgactcttaagctacagtatcctacctggtgctccctgggcttctctgtccttgggggtccccggggctgatggcagtgggctggcctgggcctgcgatggaacgtgtgtccccggtgcccaggagatgtcctcgctcctgctggcccggggcacaccgccgtcaccaggggcctcaccttccccctcggtgctgatagcacaggctcttgaaccttactcagtctccgcggtgagggagggtgtggaaggtctcctggctgtcatccgaatccgagtagagagtccgggtgtgggaggcctgtggtgggggctgccgcgagcttagaggtggctgttcagacccaggtgcccggtacctttgcttatcgtctctgcagctgacgagaagtgcttcttcaggggctggtcgggtcctggtggggcgtcggctgcactgacacggattatccgtgtgagcccggcggttgtcagagaagacttatcaaaaacagacggtggagtaaaaatcaggaataaccatcagactcctttcctttagtgaccagcctcccggcatctgctgctgtcaggtctgcaggaggtcaagcgggcagaggccggcaggcccccaggaaaggccagcgtgccctgggcccaccagggccatccgaagacgtttgtggactcaactctttgttttcttcccagttggacagcgtatccgtgaaacacacagctttatcccttgttgccgtcattttgaagagagccttaaagaccatcgagcactgcctgaataaagaggcctggcaggagtcaggcgtctacacggccgccatgatggaagacttcgtgcggctcttcagagaagctttgagcaaggtaggcccggagccaggtgtggcctctccttacaggtagcacagcagctgggagagacgagcttgggggcgcagagggtgggggtgaagtgaagggaagtggtcggggggcgttcctgggacttctggtctccttaggaaccgttgcaccgcttcgctcccctccctgctgctgcacattggccgggctggggccgcagtgacgggcagcctgctacctcttccccaggcttggtctgatgagcaaggagcctgagcatccatggcctggctgaccgtccagaaggggcatccacaggcttgctgggcagggtgcccccagcctgtcctaagggtgaattgcttagttcccaatgtctggctctggtgagcgagtctttaggggtgtcttttaatgatcagtacttgtgttttcatccgacggatggaagagcctggcgggcgacagtccatggtgtcacaaagagtcagagacaaagtgagcgactgagcacgtgcttgtgtgttcaccagatccttaccgggctcagttcggggacttataccccaaaacagagctcccagaggccaaggtctctcccttaggcactcgcgtgtgctggcccctcttccctgttctttgcttctcatcattagtgggatcagtttgtttctcttcctctcagtgtgactgattttttgtttttttgtttgtttcctttcagattttaccagacctgaatgccatcatctgggtctggcagtctctcaggaagcaagactcagaacacgatgacgagaaaggaaagaaaaaggccagcaagaccgctgctccctgcatggctcccgagagtggtgagggctgtttgcacacaccactggcccaggcagcctgggagcctcctctcccagggagcttgtgaaggcctctctgactctgaaagaatcctgtgtcctttttggcttagtgagaaggaggagcctagcatcgtactttgggtttcaacatctgttagaaatgtactcaagctttatgcaagcaccacgcacatctctctcaacccttgcatgatggatgccatgtgctcggccttccggtgggtggagggtggtggcaggcgtaggacactcttctgttctgcgagtagaacattacccccgggtagtaagacgcgctgcctcagaccttggcattggcgaggtgtggtgctttgtgtcttgtatctctgtcctgtttaatccttctttcggctctgtggggtgtaggccccgctgcgtgtcccccttgttcagacgaggaccctgaagcacagagagcccgagtagctttaccctgcccagggtcacagcagtgaagtggggatttagacccagcctgtttgagcatcttgacttctttaccacattgactccctaatctcgcgccgtgggcatctgtctgcagcctcagtgttctgcgtgcagttgaccgtgatgggattgcttactgattgaggacagagaacgagggtgtttcctgattcacactgttcgattctgattcagatgatgcagaaaccattcttctgaaagccgtgctgctccaggtcatctgcctctaccagaaggtggtcccgcacgtggtcatgcagtacaactttgacttcagcaagctcctgaaaggtacgtcctgagtgatggcaggtgcccctctgctgggcctgcccgtgggggtgaaggggctgcagataaaccgggtccccagggcagaggaccgggaaggcgggtgggtggcttggccggcttgtgtgatccactggcctggttgttttcttctggatcagtgtcggtctttacagaaatatcagatgaacacttaacagcaccaggagagaaaagggagaagccagccaggctgagttgtctgccaggggtgatccgtagatgagattctgtgctaagtcgcttcagtcctgtccgactctttgcaacccatgggctgtagcccgccaggctcctcagtccatgggattctccaggcaagaacactggagtgggttaccatggcctcctccaggggatcttcccaacccagggatcaaacctatgtctcttacgtcttttgcattggcaagtgggttctttaccacgagtgccatatagatgagattcttctttaccattgggaagccacataggtgagattatgagatgttgattgtaaatcttcttttcaaaggaaaaggggtacagaaatgagagcccctgaggaggtccccatgcacacgcgcttttgacatagttactcagatttgactcaagttctaaccacatcttatagaagtaacttcgtgcttgtccggccacatttccttgatggaagaatttgtctactaacactgacttcataactgggccaacggaggaagacttgcagaaataatcagtcttggaatttatctaagctgtttaaatagtcctgttcaaaaagctacagttaagtttttgatggttcgaaggcagaaagttctcttgccgtgagaagacgagatttgctagaatgtggccactgaatgtttactcaccgcatccttcccaagtaaatggttaacccagaaatgaggccaggggctgaggaccccgcctcgggtactggtggccacaggctgtgcataagatgctggctgtcctgggagcaaggcccgtgtcccccaccaggggtcgcactgacaggagactgtatggaggaacatgtgccaaggggcttccagctgtcggggtggtcagtgtggccgagcgcagggaagggcttcctgggcccagcagcgtcccagctcttgagtgaaaggtttggggtgaccgcaggtcaggggggtctgaggcgcgtggacaggagagtgggcgcagggtgggccgagccccacgcccttccacctgtctccaccaacagttcctcgtcggatcctcgtggccggggcatcagcagccaggcctccccctccccctgacttctcatctgttttcctcttgtccgcccgcaggggtcatctcagaagagggcctgcgggaggaggtgcccccgcttctgcagcaccacattctcaaggtggccctggagctgcccgccagcaagtttctgtggttaaaggcccaggtacgaggccgagagcccgccctgtggcctgagttcccctgcaggctgggcggctgtctgggaatttctagctggatcagaacccagaccgccagttccagaggaggacatccgcggttctcctcttagagcaaaacctccacctagaggccaggtctggatttgtgagccaggaatgtcttgactctgcaaacgaacgtgcttagctgtccttactgaaaagacatcgttgccacatactgcgagtttttgtgttcttctaagaggacttttacatttttctggcccttttaaaacctttttggaaagaaacaaaatacatttcttctcttttgtcctcatcctggaatgactcaagatggagctggagatagacaccaaggcaggagagggttgaggctggtggagaaaaggctgctggtgccgctctctgtgtctgtgatagcgtctgctagccctttctggagaacgtaatgttgaccaataaaggggactcaggatgcaagagatgttcatccatgtgcttaaatacaggatgctatgtcgccctatccagggagggaaaatgaccaggtcaaattaagcactgtcgataaggatgtatctcagtagctcagatgacttgttttaatgactcaggttttccatgagctcttgcaaggaactgtcagtgtggaaattgttagaggcattgttagaggtgaaactcccagagaggtacaggaacgctgtggcactgggggctctgtgttcccctaagtcctctctttatggttcacctgtgtcacagctgagaagagttcttatccaggacttagcgccaggcttggcacgagtgttctacgtatcgtctcgttgaccgccactcccagacaaaggcagctggagcgcagagtggttaggagacttctggggtcctggggggtccaggactggacctggggagtgtggcccagaacctgctctcaacctggtgaagtcactgccaggactgcaggactacggcattaagtggagtcaggtagccctgggtggtgtggttccccaccagcctctggccatctagggtgtttggtttatcatcccagctgacccggaccattgagatctcgctgatttagttggaaagtgagcagagagccctcttgaaagagctggtattaacatagtagtttatagcctgtgcttcagtttttggttttaataagggtctgctgggctttgtgaatgccagctccttaggggctcagatcggagctgtagggactccccaggaaaacacagagtctgcacgggatctggagctccatgtgctcaaagcccagaagcctctgagagtctgaatcgtgtataaagggaccagttacatcacaccggcgtcttgctgagatgcagcgcatacagcattaggtggactcagatagccctggtggtgtggttccccaccagcctctggagctgcatctgtgccagggcttccgggcttgagtcccacctcagtcattaaaacagcctgttaacctccttgtatctcagtgtccgcgcgcgtggaaagggagtgacagtcgtccccagctcaggcttgtcgggaggataaagcgagtctgcgtctgtgaagcacccgaagggccccctgcttcctgctgtgactctgttgttgctgccgctgctgtcaggggctaggaggctgagcctgctgactccggaggttcctcgtgcctgacgtcccagcaggcttgccaaggggtggttgagatgaggcgagaggctggagagaagcctgggcctgtagtatctgttcactcagcagcagtgacctctgttataactttgtcattcaaactccaggaaggcccagatgcagaaatcattggaggcaaacgatcggtgttttacttactgatgaaaatgtttgtgaccagtggccattcacagctcaagtcatcaaccaaacttctgattgtgaaggtgagccttttctataccagtttcgcataatctttctttgctgaattacgaatgtattacgaccgacataatttaaggagagagagttttatggcagctgtaatttattctgtcttcacctgcttgtgttcccgagaggcggcctggtgaagtggggaaagccagcactttgatccctggttctgccccttcagggggcgtcggacttcctgcttaacctctctgaacttagttttctcgaagcaaatggggataacaaagctagaactacagaagaaatgacatgtgatctgggctcagtaaacattagattgcccgccctctggggaccagtttagtaggcaatgcctcggccttcatctccagactcagccctctccagggcttcagccttttgacctaggccatcaccacagcccaagtgtcaccaaagttagaggaaggagatgagtttgttggtgtctcttctttcttacacttgaccttgttttccagagctttttaggtcttaactgcagtgctaggaaatccagttccttggttctgctttgtcaggggcttgggcgacggggggagttgctacaaaaatcacattcactgtgtttggtagtttagtcgctcagtcgcgtccgactttctgcgaccccatggacttgggcccgccaggctcctctgtccaagggattctccaggcaagaatactggagtgggttgccattcccagcccagggatcgaacccaggtctcctgcatcgcaggcagatgcattaactatcagaaccactagagaaaagtttagggtacaaagacttcaccttttatagaagtgccagttgtctctctggcacttgaacctcacatgagctgcccggaggatgagaacgtctgggtcttgacctctggcctctgcacgcctgtgctgatgtgtgatctcacgaccactccctgcatgtgggtggaacggcctgccaggctctccctcggtgcggggctcgcactcctgagaccccaagtcctgtcatctgaccacgtggggctgtcacttcaccaagtcttgcctcgaaacacattctcccctctttagaaacggcggtgcttccggcccaggcctgggtctagaggggccacgctgagatggcgcagctggttggctccctgtcttgaggactctcacacaggctgaggatcaagtccagcttgaaagtcagacttgccagtggcagctgggtgttttaggagtcgaagggaaggaataaacagcaaggcgaggggctgcgttctccgtgatagagcccagagccacctctcgtcgctggcagaggggagtgctgttccgagctgtagcttacggaggagagccgaatggaacttcggccccatgtgcacttcccggggttcaaaaggagaccgagacctcagaaagcggggtcccaccctgacttacccctgctgtctgcctcccaacagatcctgcgggacacgggtgtgtttgagcacacctggccggagctggagctgtggctggagcacttggatgacatggcggaggagaacaaggaggctgtgattcagtttttggaacgcgtgagcacctatttcccgtgtagaggaacgttcaggaagatatattcagtgatccttagtgtatttaaggtgtttcttaggcaattaagaggcctttcttcctggctcacttcctaattcttgctaagacatgagaaactacttagttttagcatctgtaaaatgggaatatatcactgagtgctatttaacttcccttggggcattcgttttcacaggagggattagtggtacactaaagtgaaagtgaagtcgctcagtcgtatctgactgtttgcgacctcatgaactgtagcctgccaggctcctccatccatgggattttccaggcaaggacactgcagttggttgtcatttccttctccagggtatcttcccaactcagggcttgaacccgggtctcctgtactgcaggtagactctttaccatctgagccaccagggaagcccacagtggtatactaaaattagtattaaaagcaatagtctagtgtgaaaaggagataatttttttaagttctacaacagaaagtttttttaaaaacttggcagcaaaagtattgctcttactaaggcctattaagattcttgctcttccctttatttcaactgtgacttctaggggcacttttcatcccacctgtgactgtctaaacacttcccacttgactcttcaatgctcaggtcctcctgacgttggtggcgaatccgtattcgtacacggacaaggcatctgacttcgtccaggaagccagcgccctgcaggcccccgggacgcggcaggacgctgatgacgccagcattcccatctcccacatcgacggtaggtgccattccccagtgctccttgggcttctgaagagccagccatggtggcgtgttagagacagacagcagaatggctctctgaagcctcgtgcagagggcagatgtcccccactttctttgcgtcagagatcagccccctctggaattgggaatccccttgtttgttcctgtagcaggaaatgcgtctgggggcttactcgctgccttattttcgtctgtgcagtgtttacactgtgccaggtgctgctccgagctccttacagaccctaacttgtataacctcacgaacaaccccagagtgggcaggctgtccccattgcaggtctggacaaggcagttcaggcacagagagactaagcggtcttcccggcctcacccagcgagcacgcagcaaggtcagggttcaactccagaccctgtggccccagtctgcgcgttaacctctctacgctcttgtcgcttctcagctgttggcttgtttccctgactggttgaagtttgtgggcttttctcagtgtcacctaaggaaacgtcaacccattatcacctgagtggataatcttgcattttgtcctgcagagataatgaagatttttacagacgataccgtatctgtttagaatcaaacattacattaagcgttttccccctaagagaagtttagcttttctttgttcccctctatgcaagtgttctctttcgtgccctccaggggcttcatgccgtagaaaccgccagtgcctctttacctgggcctgactccccccgtttccatctccagatgtcctcgacatggtggatgtgctggtggaaggcagcgaaggcttggatgaggaggttggcttcgtcctgaatgaagacacgatcctcctcacgttcccgttcagcgccttggtccccgccgccctggaggccaggaataagttgctccttggaacagaaagtgaagcaggtacccatgcgtggtcagggtcttctgagtgcatcaggccagctgggtctctggagggtaggaggtgggcttccaggggctctggaaataattgctgcaaacccaaggcagcaagggttcagacccaccaaagtgacagctgcacagctggtagagctcagtgtgcaggaatcaggggtctggaggctgactcggctgtcggggtaatgggtcatctgacagatgagcctgaaattgtgtgtttgcatggctgcagacagctgcggtcacaccagtgtttcccctttggtctttattcatgattatcttgatgctgagcgcttccctggtggccgagatggtaaagaacccgccagccagtgctggagacctgggttcaatccctgggtcgggaaaatcccctggagaagggtatggacacccactccagtgttcttgcctggagaatggacagaggatcctggagggctacagtccgtggggtcgcagagtcagacacgactgagcgtctgacaaacatcttgatgctaagggacaagtccttcatctctcctgggtatccaggaaacatacaccaaaggaagcactcacggatcacagagatgtcatttagtcaggatcgttcgggatttgctgcagtaacagctacgtcccaatgcatcagtggtttagggactaagggtctcttgcttgaccttgtccaggacaggtcaggtgctctcctgggtggttgtcgtccaggagatcacggctgctcccatcttattatctgtgccgtctcaacatacagcacccagagtgcctgtggaaggggaggagagtgtggacagtccctcagggtgctctggccaggcctggaagcggctaagccagttgtggggtccctgcctgactgcagggaggccgtgtgccgaggtagagaggaagtggcttggtttgcatcaagcagatcctggaggccttggcctcacctcttctgggcctgggtctcccacttctgggcctccgcacctgcggtctactgtgtgctgtatgtttaagtaaaagtctgctgtggtctgcagtggtagcctctgccttccatcgtggtcgtgtgatcccttagagtcatgatgaatctttctgggtctcgaattcgtgcgggagttggggtgactgatggtcccagcaagctccttcctcccacacaggagagagcgttgtggcatatctgaccggggttctcacggacctgctccatacccagagagacccactggccctgtgtcttctgcttcagtcttacgaccagttggagcctccaagcctgccttgccgccaccggctgtccgggttcaacagatactacagcctctggatcccagagccagccctcgaggccctggtgagccacgcgacccagcagaaaccaggccttcctttccctgggaaaccctggaggcccctgcccgtgggccgcagcagcctgtaccccagctgtgtagcttttctcagctcacagggtgaactttcttcaccttctcgttttccttggttagaagaggaagcgcagtggtgatcagctgacatgtcgagagtcaaagggcctcagtgatggggcagaattgaaatccccgctggctacatgactgggggaggaggtcccttctcccttttgcatagtctgtacacgctggccctgtggccctcgtccagacaccccagcaccccctagaccaggggtgcccagcagtcagacctggcccctgaaggctgccagccagctacgttctgctaaaactggaaaagcaaaaaaggaaagaaggaaacccattttctcttggtgaggactgcattcttagcacattattgaccaggagctttttgcagaaattaacaggtgtggctggccgtttgttacgtaagtgaatattgaaataactccactcagtaacattcgggcagtgaaagaagaattaaaatgtcggtggtcaataagttgttaaaaggggtgctgcaggtctggccctaacatggaggactgaggatcgctgagtggggcaggaaggtgtgcatttttgtgttttcagtcagttgtggctgcgcttaaaaaagcaggcagctgggactcctcgcctcacggacttggtggcggtagctcaggttgactgcgtgttcgctgtttgtcagggcctactcctaagggcagtgtgtgtcttttccgccacttaaccctcccaactcagaggtcaggacttcctgtcctcgtcgtacacatggggaaacggaggtgcggagcgactccaccaccagtcagcggtggactcaggcttttgccaggcagccgggcgccagagcccaggcccgtcaacggccatcaccgccttcctgcctgccaggccgtggttaggagctggtcagagccacacagcagcccccgtgggtcagcagtcgggtggtgccatggtgctcccagggtcagcgtccaccatgtggagctgggcgcaggccgttcccacccacgagggtgcatccggatccccagatgctcagtcactgcgcaagtctgttcagcaggtctgtgcgggcctgggagtctgcatctttagcaggttcctagttagtgctgctgctggcccagggaccccacctccagccccgctgagtttcagggctcatgcagcctagttgtgttggccttaggaagcggagtgttcggaggtgtaacagtacaggccctgtgggctaaataaagatggcagttgggaatgaagttagaagaaatgaacccctttgagacaggctggttgcaggaatctgtcttccaagcactccctgtcatcctatccttccgggggaggccttcgaaaggtctgcagctcgctgagctcaccccttcccggggcaggacttcccagtctgcagggatcgatcacagtgactcccgtttgagtgaagtcctgtctttgtcccgggcggctgcggttctccagggcatgtaaataacctccccgacccagcgccctcacgtgaacacacgctaggataaaacacgtgtgactgagcgcgttgggcttgatgggcttgtgtggtttcagcatcagtgggtgactttctgtgacgcgcctcgctgtcgtgcgcgtcacccatccctgtcgccacactccgtgcccttggcccccttggctgatccctctgcccttctcacctctgctgtcctccagccgctgcagacttcgggcagccctgccgcaccaggccccgcggccccgtccttctcctccctgttgcagacggcctacgccagtcaggaccaaggccagggcccaggcgggctcctactcctggacgacggggttcaggcgcagctgcgggcggccctcctgcgcctcccgatgcaccaggccctgcgcgccgccaaacacctgctgctgtacatcaggagcgccgtggagaacttcgcccaggtcagcgctgccctggtcccctgcatcaccgcccacggcgagcgtggcttctgctgtggcttctcacttcggaactgagtggtagtgtggattggagcatcccagggccctgctgtcgccctgctcgttctgcacgtggggaggctggtggccagtgcgcagggccccgggcaggcctgtagtccgggtggctggtctggctcccttctccctggagcagaggtctagatcccagatggggagcccagcacagctgaacttggtcacccaggcagcgatcggtcaggacggggccctgccaatggctgaccaggtcagcatcacagccaggcctcccatcttccttcatgagtttaaatttagtggctcattgttgagtgttctgtccctgagctgctttaccagagttttagcttagattttgaggggcgcctttccttttcatcttggtcaaaacaaacctcagtgtttcatgaagatttaggagaacatgtcttaattaagacggcttcccaggtggcgctagtggtcaagaaccgcctgccaatgcaggagacacaggttcgattcctgggtggggaagatgccctggaggaggaaatggcaacccactccagtattcttgcctggagaatcccatggacagaggagcctggcaggccacagtccagagggtcacaaaaagtcaggcacaactgaagcgacttagcacgcatgtcttactgagacacgactttgatgttgttggtgttgccgtttgagccccgtctccctctttgatcctggtttctggcagcgttgcccgatctgcgccgggggacctggcggtgagtgtcggcccttccaggcctgagggtcgtgtgtcttgcctcacagctgggccggagtgcggggccgcccctgctgcagctcctcctggatctcctccggcgcctggtcatccactgcctgcagctggacgcgcagaaccagcagaagtgcgaggccgcccaggccgagtccgacctctttgtggacatggagtccgtggcctcgctggagctggccagcgacaaggttcggctacccttcttcccccttcctgttggcctttgtcctaggaggttatagatgctggttttccctctcttctggttggaagctagcacctgttcattgcagggaagcagggaaaagcagaggccactagaggagatactaaacaccacccgcacccccatcctgagggaggcatgttcactttgggtgctcacacccccttctgcgaacacttttccctcccactgtgcgccccgagcatcctcagaacccagcctgcatcttttccttgtaaaggggttgtggcctgtattgagtaaaggctgggcagggggtgcggccctccatcgtgaatacttccagcgaccactctgcccgagaaaagtgagcctcctcctcttgctggtggctcggcaatcagctgcttacctaaggcccgaccaagtctttctcacctgtttgccatttgagatgttatgtggggttcaggaagcaggcatgttcctcatttcataatcaaatgccgggctcccgtgctttggtctccgagggggcttttggggcggggtgttggtgcaggaccacctgttagccagtcatcaggcacagcactcctaatctgtgctttgctgttttcacttgggaaagctcagttggcaaattcgtaggcttctcttcccttccctgaagagtaaataaggagaaaaatagatttctgtccccaggggctgggtggcctccttggctaggaaacatgtgcagcaaggctgactcagatccctctctgatgcagccaagggtgctcggctgctctctgctcagtggtttaaactagtctcggggtcagagttcgttccctgagggcctagtctccttctgagagtggactcaggctcaccttcagttctagcccatgtaagccctgcccacctccctcagccacagagtttcttctcagtggaggccaccctgcctctgtggtctggtggtactcacgtccctttcccacatttacttaggagggcagggctgctagggagagaccagaagatgacggattgtaattgcatgtcagcatctctgcgtagacatggcctgcctgagtgaccatggagagcagtttctctgcacatttagttcattcagcctccgttcatcagattcctgctggtctcgggcagaggggcactaactgagttacaatccaggccccttggtctcatctgggaggaggtgcatcccagtggggtcacagttctgagtgggtctgggtcggggtgctgtgggcaccccccaagaagggcaggggagcttgaacttgaggccagaggtggctgaggaaagctgccctccactgtccgtccggctcgagggcagccgctggcggggcggcggctgaggcctctaccctgtggctctgttccagacgctggaggaggtgctggtggctgttctcagacaccccacgctggagggctggttcctggccctggagcagcaggccctcccgccgcatgccctcagcccggtcctcgtgaagctcctggcagccagcctcagctcggggatccttccgctgctggtggccagtgctccagccctgcggagccttggtcagttgggcctgctggccaggtactcaaaggccatcacccagagtgtcctccgcgagctgcacagcctgagggccagctcggccacgtcaacgccaaaaaccctcctccctccgctcgaggccctgcgggggctgcacctctacatggaggacgccccactccgggaggtcaccctggccctgctgagcctgcccgaggcccgcctggcggcccagcgacccacccagcacccccggaaggagagaccgctgactgccctcgggaggaccctggtccagctgctgagtggccacgcccaggagcagccgcagagcggggagcccctctgggcctctgagtacgtgcggggcctggcagctctgctgcccgcgctggccgtggctgagctggacgccgtgctgcttggggctctgcaaagagagctggcgctggtccctgcggtcaggctggccctgcttgatgactgcctggcgcggcggacgccggcggccctggccacagcagccctgctcctgcagcacagctggtcgcaccggctgcgcttcgagcgctggtgccagcaggccggctccggactctgcctgcgggaggccccggacgacttcctccccatcgtccatgtgtacctgcagggcaggactcagggatgcttcacacgccccacagaaggtacgggaaggggtggctgggggcagctgggaggaccctgtctcttcctccccgtgtgtccacccttaagccctggagcctcacattccagggttcgatttagctctgtttccccgctggtgtctgccccagctccagagttagctccaagttacccagaggaagctggggcagtagctgtggccactgggggccaaggaaggagcagctgcatctgggtctcgctagggggagaggggtcgctcgggtgagggtcctttgcccctttccccaccgtccagcacgttggttgagcttgctgagcggagccattcagccgcacccagctctctctcttccctcactgggtctcagatttgaggcactttctgatcaccccagtttaattccttttgaccagtatgtatgaatggcgtttcgctcactgctttgcctctgtgcctcatggcttgatatcatcgatgacaaaaaaatgttcttacaaagtaagaggccctccactcatacggcctgtggttctccctgcccctctcctgttcccgagtgagttcaggacttgagtgctcatcgtctcatcatgacttgtgagctggggcccccgggctgaacggcccctgcgaggaccgttgagcgttgacaggtggccagtggcgtgctgctgaatgctttaatatccagctctcaggggaggctgatgtgtagcgtttgtcagtttccatggcatcaaaacttgccagggtcccacctcgagccaccagtgcgagctcagccaggtcacaaggtttctaaagcaccgagctggctctggtgctccgtggtgtccgatcctcctctcccattcatctccgccccagcttcctccgctgtcattcctgtcttgaggaaggctctgtggatgccgctgcaggccaggcttctcagcgccgacgggcccccagagtccgggctgccgcagcagatcctggcccagctggtcccgtttgccagagccaaggacctacgtgccctcatggaccgcttgcccagcttgctgcagactccagccagtcacacgaggtatgaaagctcagctctgtctgatggcccttcctgtcccagctgccccttccctgtagtgcttaagaaaccgtgaaagttgctgccctgcggttgtgtcagcagtgaggaggcagttccttggagaacccatcttaatagcaccctggctggagcgagtccatgtccataagtggaaggttctgagtcccttagagctgtggtcctcaatgaggggtgattttgcctgctccaggggacagttggcattgtctcacatttttttgttgtcacgatatgggactgagtctagcttttggctcccagaggatagaggccaagggtacagctaaatatcctgtaatgcataggacaggcccttcccccagagaaagaattatccggccccggacatcaatagtgctaaggttgagatagcttgatcagacagagtctggacaatacatcctttttctggtatgttaatagtgtttctcctcatcataaagttctggtacatctttgcagtctgagtaaggggcaggcgaagcctctgatttctgagcttggggagttagttgtagggaccgggactcagggcgtttgtcttctgtggccttttgtgatgttggattataccaaaagcctcgaaccctggacttgtgtctcctgctgcagctgggtcgtggctgatgctgtctcagccgtcctggaagggtcagcagaagagctgcaagcctggaaaaagactctactgaaggcctgtgtgcagtggctaattgcatccttcagtggcggccagcaggaggacggtacccaggatcaggagaagcaaatgctgctgaggtttaacgaactgttggtaggtgtctcttattagggaccctggttagattcataatggaaggagggagatagacaaaccgaggtttacagatacatttaagctgggggcatgaattcaacctaccggggaataagaggggccatgtcttagaggcaaaaggcaggtggagggcaaactctgaaatgatgagccatcttgtgtcagaaatggatgttgagatttgtaaaaatgcttttttgttgcacttcctgagatggttatctggttttgtgttagactgttaataagctgaataatattaattgatttttgaacattaaaccaaccttgcattcctaggttaaacctactcagtcatgacatattaccatttttatgtactcttggatttgatttgctgatactttattaagaatttttgtatatctgtccatgaagcgtatgagcttaaaattttattttcttgtaacatccttgtctggctttgagatcaggtaatagcggcctgcaatgtgggagacctgggttcagtccctgggttgggaagagcccctggaggagggcatggcaccccaccccagtacccttgcttggagaatgccatggacagaggagcctggcgggctacagtccatggggtcgcagagttggacacgactgagtgacccagcgcaacagtggcctcagaatgagtcaggaagagtctccctgggcacaaggttccaggttaacagtttttcatttccttcaggcattttagaggtgttgctttactgtcttccggtgtgctttgtttctgacgagaagcctctcgtttaaaaaaattaattatttattggctggactggatctttgttgctgcacacaggtttttttctatagtggcagtgagtgggggccactctgtagacgcgggtcacaagcttcttgctgcggtggcttctcttgttgcagagcgtgggctcgagggcacgagggctcagaagtctcgatgtgtaggctcagttgctgcggtgcacaggccttgcagcacatttatctccccagaccagggatcgaacctgtgatccctgcagtggcaggcggattcttagccactgcactatcagggaagtccagagatctctccttattgtctctgtttctctgtactttcccacccccccagcttcttcgaggattttttttctcttacatggcttaaacaatttgatgatgatacaccttagtgtcattttcttcaggttttcagtgctttgggttcagtgagcttcctggttttgtgagtttggagttttcataaaatttggaactatttagctgtttcgggccttcactgtctgtcatttttagtgttacatttttgcacagaaataattaacatcccaaaggctagtgtgtgagtttttcctcaacccatggtgtaaacaaaggtccatgtagtcaaagctatggtttttccagtggtcatgcatggatgtgagagttggactataaagaaagctgagtgccaaagaattgatgcttttgaactgtggtgttgcagaagactcttgagagtcccttggactgcaaggagatccaaccagtccatcctaagggaaatcagtcctgaatattcattggaaggactgaggctgaagtgaaactccaatacttttggccacctgatgcgaagaactgactcgtgggaaaagaccctgatgctgggaaagattgaaggcaggaggagaaggggatgacaggggataaggtgattggatggtatcaccaactcaacagacatgagtttgagcaagctccgggagttggtggtagacagggaggcctggcatgttgcagtccatggggtcacagagaatcggacatgactgagcaactgaactgaatggtgtaaagttgtgttaaatgtagagcctttgactggtgtgtcaccgctgaacccgagacttaaaagggaatcctcaggagaagagccccagctggaaggttttaagtgtgataaatatgtttataggttgtagatcaagctgcagtgcctgagcagttctgttaaaggagtttcagttcagttcagttcagtcatgtccgactctgcgacctcattgactgcagcacgccaggcctccttgtccatccccgactcccggaatttactcaaactcacctccactgagttggtgatgccatccaaccatctcatcctctgtcgtccccttctcctcccaccctcaatctttcccagcatcagagtcttttcgaatgagtcagctcttcgcatcaggtggccaaagtattggagtttataacctgcatttcagacttactgggttgtgttacaggactgtgaacttatgacatataggaacccaacacagcagaactaggggcgaggaggagcacccccgagacctggaaggagccgagctggggaggtggggttgtggggctatgccgttgtagagatttgtgttctcggggcacacctccctccctcccccactttgctgtttccccctctctctctctcctttttagcagactaaaagtttttagagcagatttaggttcagagcaccattgggcaggaagtaccgagttcctgtgtgccccacccccacacatgcacagccaccctgctatcaatagcctccccatagacctttgcttgtaatcaaagtgtgccttcatctcgtgcagtataagattgtaagtgtgtagtgtaccattggcaagtacacacccctacaccccagagtcctacccagggttttcatcattccagaaagctctctcgtgctttttcctggtctgtcccctccccgccagagcagccactcttgtggtgtgacatcacggagcgtgtttggagactgtctccacggcaggggctgtgggcctctgacaggcctgttaggacgcagtggtcttgccctgggtggatgttcactcttgtgtttaagcagtcacatgtggctacacccgtgtgtgtgttgcgaatcagtcagtgctatttggtgtggtggacaaagcggaagttacagaactgttcgggaatttcctttcggtcactggtgaccataggtatctaataaaatgacagaagtactagtggaaataacaatttaaaaaagtcaaaggaagagagaactgcttgcttttgtgaattgcttcagtaactgtagtctatatttactgaaaggctgtagtttaaatcccatgtcctctattttaagttaattcagatattctacatgtatttctcacttactttattcctagaattcacttaatgaagttgaccctggtgattggcagaaatttgtgaagaccggactcaagtaagtcgaatttgttttcttggggcggctcagtaaggcagtgagtgtctttgctcggggtggggtcggagctgttattgcagaggaggtggtgcagctggtgctgctctcatttggggcggaggagacagcagtgctggggagggaaacgccctgccccgtgttacacgtgtgcttctaacgagggtgggacaagcagactttaaacaacaagtatttttttaaaagccagaggtgtgcagagagtaatatagtagcacccagatgtagtaaagaccgacagttttctctgtcctcatggactctcttccctccctcgtccaagtgtcgtcgttctgaggttgactctgtcatggccctatgtgtttttaacactttggttgcatgtcagtatatctctagacaacaaaccacagtgttttttgtgtttgacattgtacacggatgtatcaatttactgtccctttggtgcactcagaagttttcgggtgacccttgttgagaccctcgttggtacgtgagatgatcccggtcattccttcccgctgcccgggggcattctgtcttctgactgtgccccattcatttggctggtcccctgctgacggacggagcctcccctctctccttcccgcctcccttccgtcctgacagtgaatgtttcatgtctccttgtgcccgcgtgccagatttttctgggtgagggggcacccactggctcttactgtgggcacagcttcagttctactagatttttgtttgttccccaaggttttcttgtcgtaacacagagtggaagctcattttgtcctcacatgctcaccagcagttcatgcagtcagactttctttttgccactcaggtagtcatgaaacagtgtctcattgtggctctaattttcatttccctaattatacccaccgatctgaaatggagaaacactaagaagaaaataagtgaaggcaggttggaggttaatggtaaccgaggcttgccttcgtgacctggcgacatttctttgagtctttggttgctttgtgtttctagaatgctcacagagtgcccagtgcttcttaacaatattcacatatgactgaaaccttcttttgcagagtgtgatgttatcatttccttcattggttctgaagggatttaagatgagaacttctgagccgttagaggggtgttttgaggagctgaaaggaaggaaggaggctgccctggcaggggggctgagggtcatctttattcaggctgccccctggcatttcagctaagcaggaagttccctgggcgtctgcactgtcaggaagggaagcgagctccgtcctgcccctggtttcagaagcgctccctgtgacgtgggccggctcggtgcgcgacgggcagtcgggatgatggtgaatgactgtgcgctctaggattctcacctttggcctcaaaggtgatctccttaataaaatgctgagaaaaaaaaaggttttcttattgtttgtgacgccgtttcccctttggttcttgcctcctaggtttcggtatcaggaccgcgcgtttttggaagccctccgtgccgccacgcagctgttgtatctcccggaaagccccgtgtgctcgcagctcacccagctcccggtggtccacatgatgctcacccagcactccctgttcctgcccaccctgctgaggaccacagaggaggagcccgcagacacccccgtgagaggtgcctcctcaccccatgccccactccagacagtttcttttctgattccatcaagctagctgtacaccggagctaagcggccacgtgttctcagagctgaggaagcgttacccaagcagtatccaaacattttatgtgggcttcccgggtggcttagtgataaaagatccacctgccaatgcaggaaatgcgggtttgatccctggactgggaagatcccatggaagtcttccccaggtggtcagtggtgacgaatcttcctgccaatcaggagaaagatgccctggagaagggactggcagcccactccagtattcttgcctggaaaatcccatggacagaggagcctggcaggctacaggccacgaggtcgcaaagagtcagacacgactgagcaactaaatgacaacaatgatctgaacatttcgtttctgtgagattcaagctctagaagtgtttcctctgatttcaggttcacagagcaaatgcacacctctttttagagcctattctggcttacgggagtcaggtttgaggtcttctgccatatcatgagcgagtgttaaaacctgggagttatggaaagttaagagggggtgtctgacctgggagaaactgttcacctgtgtgagctgtcttaatgtggtgactgaaacgttgatcaagggcaatgagtccctgctggggcctctttcttacagccccagcttcggctccttccttgccagttcactgagcgcctactttgcatggtgaaggctgtgggagatggcagaggtctgatgggtcctgccctcctgaagtcacaccctgttgttcacagacaagttgacatctcctaagtgtgagagatcgctgcagagccaactgtaataaactgctgaattggagaggaccattaccaagttcctagtgtttagttcagttcagttcagtcactcagtcatgttcaactctttgagaccccatgaatcgcactacgccaggcctccctgtccatcaccaactcccggagttcacccaaacccacgtccattgagtcggtaatgccatccagccatctcatcctctgtcgtccccttctcctcctgcccccaatccctctcagcatcagagtcttttccaatgagataacttcgcgtgaggtggccaaagtattggagtttcagcttcagcatcagtccttccaaagaaatcccaggaccaatctcctttagaatggactggttggatctccttgcagtccaagacactctcaagagtcttctccaacaccacagttcaaaagcatcaattcttcggtgctcagttttcttcacagtccaactctcacatccatacatgaccacaggaaaaaccatagccttgactagatggacctttgttggcaaagtaatgtctctgcttttcaatatgctatctaggttgatcataactttccttccaaggagtaagcatcttttaatttcatggctgcaatcaccatctgcagtgattttgaagcccagaaaaataaagtctgacactgtttccccatcaatttcccatgaagtgatgggaccagatgccatgatcttagttttctgaatgttgagttttaagccaacttttcactctcctctttcaccttcatcaagaggctttttagttcctctttctgccataacggtggtgtcatctgcatatctgaggttattgatatttctcccggcaatcttgattccagcttgtgcttcttccagcccagcatttctcatgatgtactctgcatagaagttaaataagcaggatgacaatatacagccttgacgaactccttttcctatttggaaccagtctgttattccatgtccagttgcttcctgacctgcatacaggtttctcaagaggcagatcaggtggtctggtattcccatctctttcagaattttccacagtttattgtgatccacacagtcaaaggctttggcatagtcaataaagcagaaatagatgtttttctggaactctcttgcttttttgatgatccagcggatgttggcaatttgatctctggttcctctgccttttctaaatccagcttgaacatctggaagttaacggttcacatattgctgaaacctggcttggagaattttgagcattactttactagcgtgtgagatgagtgcaattgtgctatagtttaagcattctttggcattgcctttctttgggattggaatgaaaactgaccttttccagtcccatggccactgctgagttttccaaatttgctggcatattgagtgcagcactttcgcagcatcgtctttcaggatttggaacagttcaactggaattccatcacctccactagctttgttcatagtgatgctttctaaggcccacttgacttcacattccaggatgtctggctctaggtgagtgatcacaccatcgtgattatcttggtcgtgaagatctttttagtacagttcttctgtgtattcttgccacctcttcttaatatcttctgcttctgttagggccataccatttctgtcctttatcgagcctatctttgcatgaaatgttccattggtatctctaattttcttgaagagatctctagtctttcccattctgttgttttcctctatttgtttgcattgattgctgaaggctttcttatgtcttcttgctgttctttggaactctgcattcagatgcttctatctttccttttctcctttgctttttgcttctcttcttttcacagctatttgtaaggcctccccagacagccaatttgcttttttgcatttctttttcatggggatggtcttgatccctgtcttctgcacaatgtcacaaacctctgtccatagatcatcaggcagtctatctatcagatctagtcccttaaatctatttctcacttccactgtataatcataagggatttgatttaggtcatacctgaatggtctagtggttttccctactttcttcaatttaagtctgaatttggcaataaggagttcctgatctgagccacagtcagctctcaatcttgtttttgctgactatagagcttctccatctttggctgcgaagaatataatcagtctgattttggtgttgaccatctggtgatgtccatgtgtaaagtcttctcttatattgttgtaagagggtgtttgctatgaccagtgtattctcttggcaaaattctattagcctttgccctgcttcattccgttttccaaggccaaatgtgcctgttactccaggtgtttcttgacttcctacttttgcgttccagtcccctataatgaaaaggacatcttttttgggtgttagttctaaaaggtcttgtaggtcttcatagaaccgttcaactttagcttcttcagcattactcgttggggcatagacttggattactgtgatattgaatggtttgccttggaaatgaacagagatcattctgtcgtttttgagcttgcatccaagtactgcatttcagactcttttgttgaccatgatggctactccatttcttctgagggattcttgcccgcagtagtagatatatggtcatctgagttaaattcacccattcccgtccattttagtttgctgattcctagaatgtcgacgttcactcttgccacctcctgtttgaccacttccagtttgccttgattcatggacctgacattccaggttcctatgcaatattgctctttagagcatcggaccttgcttctatcaccagtcccatccacaactgggtgttgtttttgctttggctgcatcccttcgttctttctggagtcatttctccattgatctccagtagcatattgggcacctactgacttggggagctcctctttcagtgtcctatcattttgccttttcatactgtcctactgtagtcagtagagaaaagtcaaaaggctctcccccttttcaagcaagagtagaaatactagagattttggtaacataatcatggagaaaaaggtttaggtttttaaatctgttggctcagagtttgggaagagactgaggagaggctggtaccaaagacctagggagagagatggttattaaggtgcttttacttaaaaaaaaaaaaaaaacaacgaaaatgtagggaaggactaggtgcggttctcagcctggtgttgtccaaagaagggtatctcaagcatttatgttcccagaagcacttcctcttccgctgggactctgcacctgtgcagccctgcactgctgggcagctctgtggtgttttcttccagaagcgctggtggacctgatggcggtggtggtgcggctgtgcccctctgtgtgtgcaagcagccacttcgcagtgctcctcggggcctatggtgcctcactcagcatcctgggtgagtgtggggacggtgggtgggacgcaggagggtgtggggaccgggggtgggacccaggagagtgtggagacggggggtgggacccaggagggtgtggggaccgggggtgggacccaggagggagtggggaccagggggtgggacgtggggctgtgagacagggcgctgtgactcaggagagtgtggggaccaggggtgggacctggtggtgtgggacagggcgctgtgactcaggagagtgtggggaccagggttgggacctgggggtgtgggacagggcgctgtgactcaggagagtgtcgggatcgagggatggggcccaggaatgtggggacagagtgctgtgacctggggccacagggaccagggggtgtggcttcagggtatgggcacctgctgctgttgccagaagtatttgtgaggcctcgaggagagccaccaggaggctttgtaaactgaccctcaactgatttcagaccagaagatcttacttctcctccgggcctacgaacagaacaaccacagcctcgtcagcttcaggtgggtgctgggctggcgacttcaagcagcagaccctgaaggccctgcacagggcgctccacacctgggccagcctcgggggtaaacgcgggcgggggacccctctgcttgctctgcagcgccggcgggcctgctctgccctctgcccgtgaggacggccaccgacggccgggcctgtgtgcgccgggcgccccgctggccgaccgtgtgtgtctccctcccgactcaggggtcgtttagctgatttttctgaacgcttttcgcctcgtgctggcctttaggtgggagggacttgggtatgggtgtggggaggagtggggcgtgctggctgggtgtttattccactctcctccctgtctgtgtgtgtgcacgtgtgctgtgtctgtctcttttctttcagtctttctctctgtgtctgtctgtctctcccaggttcccaggggctgcttgctccttggccagcacagctttgagcccagctccccagggcctggggctcagctgttcgtaggcggcgtttgaggtcctctttcgctgccctggtctcttgtctccttagtttgagaccagcaccccagcctctgcccagtacaaaggaagagctctgtgtactgagacaggaagttagctgactgggccaagaaaaatagttcaggagaactctgcagggaaggggaaaaatatttcccttctagaatactttttttttgaagattaaagatgtattaaccacccccactgcccatccccttcccaaaaaaagacaacaaacagttaaaaaaaaacccttttctgcatcttcagaacacccaggtcgtgaataaacattctctctccttccctcaaccccacagcctcaccctcttgctagccttgcagttggtgctgtatcagttgtattctttctgaactaaacagcccctgggtacatgagggagaggagagaaaataggagtggtttcactcacgaggacaagcgagccgtccacccatccacccctcggcatcagaaaacccctctcgggtcacaaagtccacaggggtgcccccgggttcaaatgggttaggtcactttccaggaggaaggcaaggtgacctcactgggcagtttccatcgcaaccggtggtgtgaaaagtggaaatgggggaccctagaggtggggacggagaaggcaatggcaccccactccagtactcttgcctggaaaatcccatggatggaggagcctggaaggctgcagtccatggggtcgctgagggtcggacacaactgagtgacttcactttcacttttcactttcatgcatttgagaaggaaatggcaacccactccagtgttcttgcctggagaatcccagggacgggggagcctggtgggctgccgtctatggggtcgcacagagtcggacacgactgaagtgacttagcagcagaggtggggatggctcacaggctgtgtgagcgcacctggtctgctcacggctgtgtgggaacggggaagggtttatataagtagagcatcgtcgaactgccaggattctgccgctatgcccagcccggactctccagatttgaattcctgctctgccacttaccagctgggcaggagaccagctgaccaacttcccagatcttctctgtgtctcttttcccccaatatggatgataatagtacctacctcatgggattcttgggcccccctcatagctcagttggtaaagaatctgcctgcaaggcaggagaccctggttcgatccttgaattgggaagatcccttggagaagggaatggctacccactccagtattctgacctggagaattccatggactgtatagtctatggggttgcacagagtcagacatgactgagcaactttcacttacaggattcttgtgcagattaagtggattaatacacagacttagacgagggcctggcacatcatagcccctccacaagcgttggcctccgtcatctccaacagtgtcacccccacccttattgtcatcagcctctccatcactcccacctccccctacgttatgatggggatagaacatcttacacttggcatgtcagctgcccaacaaagctgcccacggtggtctccaccatcatcacctctgtgaccgctggctctagggtactgctgtggggcccatcggccgtggagcatcagaagacgtgccggagcctgggcaagtcactatggcagcaaccgagcgttggggacatcctccgcctgctggatcgtgaccgcatgatgaagaccatcctccacttcccccagaaccggaggctgctgccccccgaggtgcgggggggccccggggcggagccatccggctttagccactgtgaaatatgagcgctgttttgcttgtgatttgttgacttcttatgagtaaaactggaaccatttacaaaggtatagagacagaacccatatacccataagccagtttcatcagttgtcagcactggccacacttaacttcatttataacttctttccacaaagcaaatatcaaaggtatcatttcacgtacaagctgtttgttgttttgtatagaaacatttttttagtacacttgaatattcaaaataatttgaactctgagtgatagtgggcaaacatccacgtggggtcacatttacgaggctgacctgcatgtttctgtctgtctcgggctgtttcaggatgcacaggagccgatatttagagaccggagcacggtggatctcggggacctttatgacccctgtttcctccttcatctcttcagtgaactgaccaggccaggtaactgcagtcttccagagtgggtggaggggtcataatttttaccataattaccagtgcatgtgcctagtcactcagtcatgtctgagtcttggcaaccccgtcgactgtaacccaccaggctcctctgtccatgggattccccaggcaagaagactagagtgggttgccatttcctcctccagaggatcttcctgatcagggattgaacctgcgtctcctgtgtctgtctcattggccggcaaattctttactgttgtgccacctgggaatcccgcataattaccagattaggacctgaatcttgaaaataattcttgaaggatcttcaactgccttctcacctttttccttccattgattttcagcaaagtaacagttaatgttttgaatacacggttgttgttgtttttaattataatttaaaaatctgggtgtgtctttcatgttttcctaactgtaatggcaaaagttctgagttctcactgaaatgagagattttgtctttgacaacgagtgagagcctgctaaggttggctttctcttggtttaagtatatctgtgaaatggccttttgtatctgctaccctgagggtgggaatcttcgcaggtaaatgggttggggagagagaaagaacagaaacatgtccaggtgcacactggtgaagacgggggtctgattcccaggctggtcgggtctgctggtgtggggcattttgtcaacaattggtgtgtaatgctatctcagtatggtgtgtatttgcattttcctaatagctaatgatgttgaacatcttatgacttacttgccatctataatcttttttggtgaaatgtcaattcatgtcttttgcccatttatcctgatgggttttatttgtttttactgttgggtcttgagggttctttatatattgtaggtatgagtcctttgtttgatacgtggtttgcaaatattttctcccagtgtgtaagcttatcttttcaccttcttaacacccttcttcaaagagcagaagtcttcagttttgatgaggtctagtttatctgttttcccttttatgggtcaagcttttggtgtcaagtcttaagaactctttgcccatccctccatcccaaagaatttctccaatgtttatttctgaaagtttcattgttgtagcctttatatttgagtctgtggcctcttttgagttaatttgtgtataaggtgtggagtgtaggtccagccacgttggtttgcctgcagatgttctgatccagccccccatttgtcaatccaccatctctcctcctcatcccttctcccagtgaccaccagccaggggagtcccggctcccctgcactgacacttcctggctgggagggcaggggtggtcgttaccactcttcacgtggccccaagcgggagcctcatccatctgctgtgttaggctccctctgatgcatcgtggggaccagtcattgtgctgcctgagagggtccctgacatctacctcctggttgccacggctgcatagattaggtgccctgagagaccatgcctcactgatcactcttctgttctccttttttaaatttgatatctcttccccgccgccctcccccgccaccggccatgcagcttgtgggatcttagttccccgcctagggtttgaaccctgggcccacgcagtgaaagctctgagtctataacccctggaccactggggaatttcctaaacttgacatctttttatactcaaatgttgctccttgcgaccagatttgctgatcctccaccactgcccttcagttcctcacagaagaatgagagggctgtgttctcagagcaaacccctgccttggtcaccaggttctgtggctgagccgaatcttctttgcaagagagcaagtgtgcatgtcaagtgatgatgatggccagcggtgactattaccagtaactggggagccatgtctactacgctctttgattcccccatgctttggctgtgccggctaagtctgtttctcatcaaatatgaaaatagattttccacagtctaaaaatatgatgcaacttcagtgaattactgcaagtcatttagtctgttgccctaattttcaatagagcatttaggaggcagaaggtagaggcttggaaaacactttaatagagaaatagtaaaatcaggactgttgttctcaggatcttgaatattgcccttttggggcaaaggagggtaggggaaggacaggatctgaaaggccttttgtgaagagagataactagtaaatgttctttcaagttagggaaatacagcccattttacattttattgttataacatttgcagatcatgtctaccagaaaggatttgcgctagcttaaaataccggttacactacgatcattcacatgaaagtagaatttttaaaaaagtgtagaaatagataggcaaatagaaatgcaaaccaaagacaccaagaaaaactaggtcgttacattttgctctgggctacttgcttataatccagaacaacaacaacaacaaaatggaagcagaatattttaaacaaatgtttatcatctgataaagggaagcatacgaattcatcaggaggggaaaactagcggtaaagggacaagctgaataaaacagaagtctgtgagcagcatttataatggccaaaggcttattgtggttgaattaagtcatcaatctttttttcatattgttattttttttaagttattattgcatttacttttgccctggtggataagtgaccatgaacaatgttttaaataaacttttattgaagtgtgatatatagaaacccatacaggtcatattatgtatgtatgagttgggggggaaaacccccagtcagatcaaggaacagaacatagtccacagccccccaggccccttgctggccaggggggcctcagtaggggccttctccctcagtaggggccagtgtcctacatttgaagtttatttaaatgacattaaacactctcttttgtagaagctccatttacccacattgcatttgtgaggttcatccatgccgcgtgtggcaggagtttttcacgcatgtttttgtttcctgaggtggcactagggtccaagtattgccgaacattttgtaatcctaaattgggtgtgtggttggtttttggtgtggtggccaggcttgagagaaccagtctcagcgttgcgtgtcaaccctttgctgaaaatgggaacctgtctccttaaccttgctgcttctctcctttgagtccttggctgagaagcagggccagccttttgccatggcagtgacaaatgctcgcacagcaaatgcttgtcctcaggagaaccaggccttcagttgctgtttaacagaacagggaggcccctgtgtggttctctctagggccgtggacagggcctcggtggaccctccctgggactcgcctttctggccaggccgcctctaggagatggtgtgagaggaggtgtgaggaggctgaggctctgacggcaccgctgcgctgccactggaccccttaaaacgtggactgctttgcattttaatccttgataattgtcctgattaagccaggacaaatttgttgtcaccaggggaaattgctatttttgaggttcttaaacaaaacgactggtatttctgttttttgatcacctttatattttcaattgtcaaggggcagctcttttccatacgttttacaaagccaagacttccagaggataacagatcccacagaacatgaaattgacttttcctcatggacatacggaaaatccttttgtctttaaagtgtccgtgattactgctaaatactagctatttttagtgagtataatattaaatgtttagaatgttctctttcccaaacttattctatttatgtgtttttattatggatcaataggtatgtaggtgtatcttaaatataactcatcttccccaaaatagtataattttatccctcagtttgatgctttgtaaagcttttgtaaattttcccccctcccatcagaagtggtcacttgttagaaatgagaaaagttagtctgtaagctgttagagcagaagagtcttctaattattctttttccttttacttttttttccttccagttttactgagatataattgacatcagcactgtataaatttaagatattcagcatagagatttgacttaacacacatcatgaaatgattacggcagtcagttgagtgagcatccaacacctcatatacaataaaattaaagaaatattttaaaatgttttccttgtgctgagaactcagcatttactctcttaccaactttgctatatagcatacaatagtgttaattaaatttattgtattgtgcattatatccctagtacttatttattatagttgggagtttgtatgttttgactcccttcatcacttttccctcctgtcccttggcgtctggtagccacaaatctgatctcttctcctctgggtttgtttgtttgttgtttttcaactatagttgacctacagcattattagttcctggtgcataacataatgatttgatgtttctgtacgtttcaaaatgatcgctgctccatcctgttacttaaaatctgcatcttgagattaaaagtggtttcttgtagacagcagacactgggttttgtttcttcatctagtctgaccatgttactgttattcagtctcagtcgtgtcttaattttatggcttcagtcaccatccacagtgattttggggcccaaaaaaataaagtctgtcactgtttcctttttttcccccccatctatttgccatgaaccaatgctttttaattggaatgtaaataccatttaatgttgattattgatctgattccacttcatttactgacttttagcagtagtttgtgtgcttgtgagtgtatgtacgtgtgtgtgtgtgtgttggttgctttaaggtttattatatacatattcaatgtattgtggtttaccttcaagtgccattataccccttcatggatagtagaagcatcttaaaatagtatctctctttcccctcctggctttcatgctttaagtatcataaattttccatccatatgttaaagatctcacaatatgtggttatttttgcttcaaactgtcaattaccttttaaagggatttaaatatttttgtttatcctgtagttatcatttcgtgttctcttcattctttaatttccatattctatcattttccttcttcccaaaacacttcttttaagaattcttgaagttcatggctgtcggtgatccattctttcagcttttaaaacgtcttaacttctgaaagattttcatggggtataaagttctaggttgacaagtttttttcttatgtgtgttaaagatgttgatgccttgattctagattgcattgtttctaacaggaaatctgctgccattcttatctttgctcctgtctatgttttgagactacctctaagatttttttaatcattgttttcaagcaatttgattatgataaacttgggtataattttattttattttattttttggactgttttggccctgtaggtttgtagtttttcaaatttggaagagttttggccattatttcttcattttcagggactccacttccacatgtattagcctgcttgaaattgtcccacaaatgctcatggttttagaattcttttttctctctgtgtttcagtctggttaaattctgttgtgtcttcaagttcacagattttttttttctgcagtgtctaatcttctgatcagcttatctagtacatttttttgtttgttttgttgaagtatagttaatttacaatgttgtgttagctttaggtatacagcaaaatgattcagttatacaacaatatatctattcttttcccttataggttattacaaaatattgagtatagttctttgggctataaggtaggccttttttccctcatatagtaatgcatgtatgttaattccatactcctaatttatttctcctccctggtcctttggtaaccataaagaagttctttttttttttaaagattccacatataggcaatatcatatgttatttctctctctcgggcttactttggttggtatgataatctctaagttcatctccatgttgctgcaaggggcattttgttcttttttatggctgagtaatattccgttgtataaatgcaccgcatcttctttatgcgttcctctgtggatgggcattcagcttgcttccatgtcttagttactgtgagtagtgctgcagtgaacattagggtgcgtgtatcttttccaattacggttgtctgcagatacacgcccaggagtgggattaccgaagcatatgttagctctatttttaattgtttaaagaaacctccattctgttcttcttagtgactgcaccagtttacgctgtcaacaattcatccagtgcatttttcatttcagaaattcaaaatttatctcgagaagcctgactaggattttcttatcttccatgtctctacttaacacacccagtctttcctctagcttcttttcatttatttgtatatttttagctgtgctgggtcttcatggctgcacggccttttctctagttgtggcgtgcaggctcagttgctgtagttcccgggctctagagcacaggctcattagttgtggcccacggacttagttgctccaaggcaagtgggattttcccagaccagggattgaacctgcatctcccaggcagattctttaccactgaaccaccagggaagtccatcctctggtttcctgagcatgtagaattcagtgctgctaactttataaatgtctttgtctactaattctgttatctgtgtcatttacaagtcatttccaaatagtaagtttttctcttcacaatgggccatgttcctgcttgtttgactgtctggcagtttttactggaagccagacattgtgagttttacctcctttggggctgggtattttgttattcttgtgaaatgttgttcagctttgttctagtacacattcaagtttcttagaaatggtttgatcctttccagtgttgcttataagctctgttagttgggaccaagcaacatttagtctggaaggacctttgccgcacaagtgaggtgacatgccctgagcctgctaccttgtccctgggtgctgcggggacttggccctggctggtgggagcctggggttgtctctgctgagccctctgggtggttctttcccagcctggggtggcttgctcacacgtgcttgccgacgggcatcctctcggtggagcactcttctctcgggctcggcctcgtgcactccggccacttggcctcccaggccccccgccgctctgtgccctcaactcagagctgcctgggctctgcctcggtttgccccactgtgcatggcctgggaactctccaggtgtgagctgcagcgatcggaggggcacctggtctcctgtcttcagggatcaccgtcctctgttgctccacgtgcagtgtcttgaaaatccttagttcgtgccttcagttgttttttcagttggacagatgagtctctttcctgtgtctctcctggctagaagtggaaatgctggtccttctgcgatacggtgtgagagctgagaaaggggaggggacccgcgcgtaagcggcttccaggagctcttgctgcttctgaggaggaagagagcttgcgtggtgcgcgggtccccgtccctggcgtgactcagcccctctcagccctgtcaccccaaggcagggactgtaggcacacccacaggtcctccaccttgtggtccctacacttttggacagccactcgtttgaggaccgttatgtgtctatatagctgtttggactaagaagaagtagctattatcattcttcttcttgatttatttttagctttttttttgtttgaactgcggacattatgtttttaagtcttaaactttggggagagatgagaaaagaaaaaagagtttgacttgtagaaaatattatcagtggtgtatatatatatatatattttttggtttatcttttattgatggtacattccaagatcactcatccgactgactacgctggcttttcctgctgagtcccttccccctaacctcaggcttcttcatgctgggacctcagtggtgggtcctgatgtcacttccgacacctctgaacatctctgatgttctccgactcctcgggtatttgtgagaagtgatgaaggagtcctcgttgggatttacaagtgtctcagagactgaaggcgtgtgattgctactgcaggagcggacagtcttttagacagccgcagcagaacctaagggagcaggaggggggcttgcatgtctgtgtccggcatgcacacacgttgctgatgatggtaaactgcaaaaggaaatggaactccgtgttgcacgcgtgtcatggaatcattgtgtgtgtgtgtgtagttaacactgtgttttatctccctcagaatttgtggtggattgtagaaaattcgtggattcaaatgctttgggcctgactgtcgcggccctcagcagctacgacccacagatgcgcgccgcagcctacgcggtgctggcggcctactactcacacctggagggggcgcgtttccgggagcagccccaggtaagcggggctgagggggcctggtgggaagatttcctgaagaattcagaggcgttgcccagagactctgatacagaaccaaagtcttgtctcctcctagcggggcggggggtggtgccagaggtcatcttgggtcctcagtcctgggtggtagagagaggtctccccttacaagaactcttcctgtgtcatggagggcagagcagttctcgtttctgtcgacttgttccttgatctgaactcaggctacagcagctgtcacccaggacacacagagcctcagaagccgtgccctgaggtggtggtgggggttgtgagcccctggatgtgaggagtgggccaccctgcaaagccatggattaggctgcccgagacaaggctggtcacagctgttctgcaaaatttccccccgaccccgccctttttcctgcttttaaggtactgtacctgttggacgtggtcaggaatgggatccgaaccaagaacatgagactcaccttcaccctgactctcttcattgccaaggcagccttgcagattttgaaaccaggtaccactgctagaatctggtcggggtgaggtggaaattctgaggctgagtgagcccatgtggttgcgttaatcgcactggcataaccggtccactgcacgtgtgtgagggtcacaagtgcaaggtgcaggagggtgtgtgtgaatgtgaaggggggccagtgtgtgttcctatctgcctgcaggcgtgtaaagctgcagtaaaggcaggtcacagctccaccagagggcctgctgagggagtcacagatgtgcatgtgcgcttggagggggcctgatgcagaggccccatcggtgctggcagccacgctccaagctctgcggtcagcgtcagcacagctcactggcgcgacgacaagcggcttgtgggtccctgtgcccgtgtcaccagggcgcagaacatggctccgcttggtcctcacagccgcccagtgtcggggtggtctgagcacaagtcagtctatcatgggaccttttctttttgtcactagtgaaaagttacagaatgttgatgccgttagggaccacagggctctgcgggtaatgcggttgttttcagacaaggagacagccttccagccgaaggttaaccccaaggttatgtcgcttcagtcatgtctgtccctttgtgaccctatggactatagcccaccaggctcctctgtccatgggattctccaggcaagaatactagagtgggttgccatttcctcctccagggcatcttcctgacccagggatcgaacctgcatctcttaggtctcctgcatctctttaccactagtgccacctgggatcccaaatagtttgtccaaggcccagcaattagtctgcagtcaagttgctgttggaattcagatcagattttcatctgctcctgtatcatttttattacatgtttttttttttttagccttagaaattatgggagggaagaaggtaattagccatttagactctaaagaaacaggctcttcagagaaaatatcctagctgaggtcatgagggatagtcttggcctcccatccagtctgtgcccccgcagtgagctgtcccacgtcagacctcatgtcagtgcaggggctcagggcagcggtcttggatgggctgtgaggctgcaggtgctttggataaatgggagatgacagtccaagggtgagaccaggggaggaggtgtcagccctattgcatcccagaccaagtgacccagggcaggtctgagccccctttgctgtggaagctccctcagtgggaggccgatgagctggtattcgccctgtgctgtcttccgtgtggcagcccgcactctgcccaccagctgattggagcttaggctgatgcctcggagggagtagtatcagcaaaggactggacatcccaaagtggttcctgagccgtgagataagcccttatgccgtgtagacctaaggtgtcttactgcattttaattcttgagaactgatcacctggatgagaattagaaagccccgtgggggcagggatttctgtctgaccatcccccccaggaccccgctccccaactccacctggtcatggggtgtccttttggcaccatcctgagtgacagtcacgcttccctggtggctcagacggtaaagcgtctgtctgcagtgcaggagacctgggtttgatccctgggtcggaaggatcccctggagaaggaaatggtgacccactccagtactcttgcctggaagatcccatggatggaggagcctggtaggctacagtccatggggtcgcaaagagtcagacacgaccgagcgacttcactttccctttgagtgacagtctgcttgtgttcacagaggagcatatgtacatgaagatcaacaagttcctgctgtcccacgagtacctgaacatgagcaaagttccaggcttctaccagttcttctacagctcggacttcgaggtagcaccctgccctgaggtccacagggcccccagtctcctaagtgggatgctcagccaccgcgccaactcgtccctgcaaagacttgtcggctacagagcatataggctggggtggagggtggggggcaggcggacctgcctgtgaaaacgctttccagtccataccgtgattctcgggtgacttctcagacctcacagactccagaggccttgagtcacagcctcctcacggttattttctgggtgaatcacaggattgattattgatgtgcttttatggaacatatgagcacagttgaggtcttccctgtagctcaaatggtacagagttctcctgcaatgcaggagaccagggttcgatccctgggtcaggaagattcccctggagaagggaatggcaatccactccagtattcttgcctcgaaaatcccatggacagaggacactggggggctacagtctgtggggtcgcaaagagtcggacacgactgagcaactaacactacactgagcacagttgagcgtgtaagtctgacctggtcctttattcctgacccagagaaatggaagcagagaggagagagggagggtttttaataacagacccagaaacggagggtcgggggctgccatgctgcagtcttcaccaccccttgaaaatagtggtgctggaagagttttcaggaaaaaaaaaaaaaaagagccttcacatgtttaacaaccgtcttgtttgcgggactttacagcagaagacggagcgggagtgggtgttggggctccttcgccagggaatgcgggacaagcactgcttcgagctgtgcgccaggcggggcgtcctccacatcgtcctgtccttcttcggcagcccgctgtgtgacgaggcggcccaggtaggcgcccccagggcctgagggctgggggggccttcactcggggttccaccacctgcaagtcccgccccgtggaccctcacctgaccgcctgcttcaacattagcttcccggccctcctgggcccagggccatctgggagggaggcgggtggtgaggaaccaggaggctctgggcagccgagagctcaggactgaggcgcttccagacacgcgcaagccaccagcgtgtcacgtaacacagagaaactgcaggtcatcagaccttggctgggaaaggagccgggctttgaaacctcctgcctcacagctgacagggagtctgcaggagttctgtccctggagcaagaaatcttgtggagtgagacgttaactaggaaaggcatatggggttttgatgagtttctagcctgatcagtgtctgtctctggcatcacctaaaatatgggtaaagaggaatgagtctgcataagtggaatttgagtacggtagatttctactttttatggcatgtgagaactctaaggcacccagttagggacttccgtggtgctccagtggttaggactccgtgcttccactgcagggggcacaggttcaatccctggttgaggaactaagattcccatatgctgtgtggtttgccaaaaaaagtatgtgtgtgtgtgtggggggggagcaccccgttaacagttccagcggcagtcgcatctctctgtcctctccacgtggtaaaacggaagcgatgaaatgagccgccagcagttcatggctggactggcaatgagtcttcactgtcccactcaggctgccaggatgcggggccgtgtggtttgcatgccacgtctccccttgtgatggattagcgggtgggtgtccctgggctgacactctccctgtggccatctgtgtcctctggctgttacggtggggcgggtggtcccccacggccaccattcccgcacacctggcagatgtcacgtgcagcgaccgcctgtggagtggggacacatcgttctgcttttaaggccttccctggttcaggtaactcaggttattcccatggaagaccaatgactttttgcttggggttgacagaactggattctggagattctgcagaatgccgcccggaatgccaggtctgcctatgagatgctgcgggactacagcctcctgacgtgggtcctaaacatcctggaaagcaagtaagcaccttatgtcctgggaagaggggttgggcaggggtaggggggaggagcgcatgcgcactgggcatggggcggggtggggggagggcgcacatgcgtgctgggcgttggggagagcacgcgtgcttgctgggtgtgggcgtggggaagcgcatgcgcactggacatccgggcgaggagggagcacgtgcatgcatggtgggcgtggggtggggtggcgtggggtggggtggcgtggggcaagggactgcgtgttatctgggcatgggtgggtataggcagaacgcatgcatgcatgctgggcatcaggcagaggggcgtgggatgagaccatgagatcatggcagctcctgcagctccagtgtccgctgggagattccaagagaatccgcgttccccaaaacagcgtcctctacaccacctttctgtctctcctgcgcggcccaggctgctctctggaagtggggttctctccgaagtttcgaggccgctgccctccctgaggcagaaatggggagcctcgggtttcgggagcgatcgctcatgcagtgatgtgggttcggcactccactcccacccagggtcgaggtgccctgctaagggtcgtaccggagccgcatcaagggctggcgtggctatcttgtcttgtgacgggggctgctgtcactaggtagctcaaatgacacggatttgttttctcacctccgagggccgacgtggtcggccttggtgagagccctcttcccggtgtccgcactgccaggtgtccgcactgccaaccgtgtcctggcagggagagagaaggagagcgctctggtctcttccgcttcttgacagacagtgacagtgaaagtcgctgagtcgtgtacgactctttgcgaccccatggactatacaatcaatggaattctccaggccagaatactggagtgggtagcctttcgcttttccagagggtcttcccaacccagggatagaactcaggtctcctgcatcgcaggcgaattctttaccagctgagccacaagcttcttacagggtgctaatccggtcatggggctccatcctcacgacctcatctaaacctaatgacctcccaaaggccccacctccaaatacagtcacagtggtggttggggcttctacctgtgaatggtggggcagggaggaagggcacacagttcagtccataacgtgatctgttttgattcctaacagtctcctgcctctgaggctgtgtgaaaagatgaagactcttgtctcgcagacagaccctcagtggcaggaatctttccttcagacaactgtctgtgataataattctgggaatattcagcctctttgcccccctgtcttttttttctttctttcttcttttgtgcatttttttaaagaatttaaaattttttctcctaaagaaagtagtatcttctctccaaaggctgcactggctgattgtctgctcctggctgttacctctgtgcttcagagtggcagaaggctgggcagggaggctctcccttctgtgccacagaggctctggagtatctcttagatgggactggggagaaaggagggttggtgagaaagtttctttcaccagaaagtttctggtgagaaaggagggttgcgccctgggatggagctgcttttgtagcagacaccctgtcttgccttaggtgctatgcccgtctgggactgcagtggctgagtgagcgcataaaagggttggaggctggggaagaagccagccccttggggtggccaccaccatcaccgtctcctccctggttcccgcccacccctccaggagatgggaggagagggtgtgacagagagctgactctccccatatttggcttcaggtttctggagaccgagctgctttccaacctcatctccctgctgcacacactgtgggtgaccacgctgggcaacagagaagtggaggccggggcacagcctccctgcaagcctggctcccaggagcccccgaagctgctggccctgcacctggtggacgagttcctctacattctccttgtgctcacgaagcacctgaggtgagcccctcccctgggtcccggctccacaggtgggctctgggccaggcctgtggtccctgtggtgacctcaggacaccatttccgctgctcctctttaacagttagattttcgaggttcctttccagaccaggagaacttaacacactcagaaaacctgcagcctgtcacgccagatcatttttagcaggcaaaccatctacttggatatttggattcaaacactgaaaatgatgttttgtagaaagaacatgttttccgtgattttaaacctaagaaagttaagctgttcccagactcacctccacctgtattagcctgcacaggctccctttcagccatgaatttcctggaaaatgtcattgttttccccttagaattacacacttggtttcctcaggagaactcagcgcttgtcagattctactgtgttagagaaaatacaccatgtcttcatacttctgatgtgggaacagaggtgtgctgattggaactagacaatggatagcaaatggattgtcatctcagagtgaaaaccttgataaagaatagggcatttcattttctgttgttctgaaatcagctattgaatccacgctgggtagccatgtttcttattttcagttcagttcagtccctcagtcgtgtccaactctttgtgaccgcatggactgcagcacgccaggcttccctctcccatcaccaactcccagagtttactcaaactcatatctgttgagtcagtgatgccatccaaccatcttatcctctgtcatccccttctcctgccttcagtttttcacagcatcagggtctttattttacagttgtccaaagacgcatggcagcctactccagcattcttgcctgggaaattccatggacacaggagccgggcaggctacagtccatgggggtcacaaagaatcggacacgaccttgcaaccaaaccaccaccaaagacacattggtctctgaaaactggttgtaattcagaataacaactgtatcaataaatgtgaaaacggttagagcagacagtttggaattttaaattccttagaacttggaggaatatatatccttccactgccctccgttaggtttggccatgagtgttgctatcccagagcttttcttggcctttagttcctgaattggagaggatccagtggtcctggagttgttagcagggcagctggcaccctgaccctctcccagtttccagagaactttctgtgcctccagggtggaggtcggaccctggtcccctgtcctcctcccctggggaggtgctgggctccatgccctggtctgttggaaagggctgcccgagctgtgggtgggccattggcacctcaagtctgtggcttgtctgctgcccggccaccgaggtcctgggctgcaggcaacaaggcggcctcgcccagcctgggattgtggactccccccacaggcccaccttggcctccgcccagctgaccggcttcttcggggcactcgactcggtcctgaggtaccgggccaccgtgctgcaggccttcaaggacatgaaccgtctgaccatgaacgccacggtgctgtccacccgggatgtccttgtgctcctgcacaagtggagcctcatcgagagagacgtccggctccaggaggacctgagggccgccacggaaaagtgccaagtccgggagctgctgagtgagtgtccgctgcgtggttctgtctcatctctcactccccaggcatgcttgctgccctccccacccccccagagcagctggcgtctcccccccacctctgagcagcatgtccacagctgccaaggcttagagacagggtctgtgtgtcttcatagcactcaagggagatggggccccagctcccgctcctctgtgctcagctgttacaatagcggtgatgacggtcacagggaaacactgaccctgcccgagctccaggctgggtgcgtcctatgggaacccagctctgagctgtgccctcccctgcgtggatgccccaccctctgcatctctgtggggacggggaaggggggaacagcagtctgatgccttttctctttttctctgtgtgtgcgggtaacagagatgctcaaggagaagaacaagcccagcgcgccagcccgagccaaaggcatgcgggcccggaagcggagacctggcgaggcggaggaggcggccgaccccgagctgccggcgtccgccctggaggcgtgcagcggcctcctgaggtccatcctgacccactgggcacccgagttccccagcgccgacccggagcgcgaagacccgggccccgtgggtgccatcgcctccctggtagccggctgggtgctgcgctccgcagccaggagtacccttggccgggcggacgcggcaggcctcctgggctggctcaagagccacgtcctgcaacagccggcggtggtggctgagcttctccgcgatggcaccgtgacgagcagcctgttccgcctgtacagccggttctgcggtgctgtggagccggcgggatcagaggaccgcttggccggcctcttcaacgccgtcctgctgcgcctggtggcggcccggggcaccgcggggatccccctccagccggtgctggagaccgtccacctctcctccctggacgccgaggaggatgcggacacacgaggtaacgtggggggctgggctcggagactaaagactgcgcggggtgggcctggggccgagagcacttcccgttctcacagcctgcgggtgctgtcagtgaagccttgtggggaggacggccctcagcccgggtctgtagagcacagagagtcagccttctgggtcctgagtgtgtgtgtgtgtggtgggggggggcggcggggaggccccacctctgccttcgtgagaccttgatggaaggggaaacagtggagaggaacgccctccgggcggccttgtgtacccctggggacgctgcgtggctttctaacttcctactgttatctcacacagagaattaggttgcacctcgtggtcacaagcacacacacttgcacatacaggcacccaagtcatagttcatatgcgcggcatttagtgggtgcttgatgaaggtgtgggggcttccccagtggtgttagcagtgaagaacctgcctgccagtgcaggagacgtgagagatgcaggttcgatccctgagtggggaacatcccctggaggtgggcagggcaacccaccccagcattctcgcctggggaatccccacagacagaggagcccaggaggtgacagtccatggggttgcagagtcagacacgactgagcgacctagcacacgatacaggtgtgcctgtgtggatgaggcaccggcaaagaccgtaagaggatagcagggaggctgtgggcatgtgcagggggctcctccgctatcaggagggttggcccttcagggagggctggagggggctggagactgggcggggccacagcccggcaggtgagctcacctggtcgcagggagccctgctgtctcccctggcctgcaaaccttcttgtctgtgcctgtggcccaaaggccacccctgccaaacttcagttgtggttcttggcctgggtgggtcagcaccaaggaagaggcttacattcaacacacagtcatcacgtgagaaaagagaggttttaaaacgaacaggaaagatgaacccagcggttgagtacagtcaggactaacgtatccacacgctcaccgcaggttgccacctggggccgagcgagccccgggtcaccgtgcgtggggtgggcggctccttcccagctgaccggcttgcatcctaacggtctcgttgtcccttcctcagccgccgccgcgttcctggtatctctgtacattaaggacatctggctgggggcccagcggccagacaccctcctgagccacgtccggatggtcctcgacactgcggaggacttgggagggggcaacgaggaggccatcgtccggctctgtagggacatcgcggccacggtccctgacatctgactcctgcggctggcacctccggctccaggtttcaggagtcgggttgagtcgggggtttccatggaaagcctgtgagacgcaggctgtgcgtgtcgacctgctgttctgacgggaaatgttggcttctctaggtgactgatacaaaagaagctcaagggaccgtgtatgcagagaggtcagggttacagtgggcctgggtggccctgggcccacgagccctggtcagggaagacccttcctctgaggtgcttgttgttcctcagagaaatacctcaaactgaggtaacgctaaagttgaaatgtctaaaagtatacgagacacagttgcatgaagagagatgtttcaagtttcctcttcataagaagtcacagcaaagctttgtgtaactttttgaataaataaacctttccagtattgtgttaaaggtattttactaaataaaaggatgttgtactaaattcttaaagtataaaactattttgtcttctgcttggaaaagactgctttatatttttaaaaattccatttgaaagcaaggactttgaattttataacttgttaataaatgtctatttttgttagatttggtgtttcgtttttattgactgaagcacagactatttttgttctacagaaacctgtattttagaagtcaggatttgacttttaagattcctgtataaattgatattgtagctgacaaacattgaatatgaaatttcatgccaggtaaaactcggtgctgttcatttgaagctctgcacgtaccattgtgccacgtcggcacacagcattcccggtctgtcactggggaggtggctgtttatttaccctaacggcatttatcacctggagaaggtcatggcaacccactccagtattcttgcctggagaatcaccacggacagaggagcccggtgggctacagtctatggggtgcacagtcggacacaactgagcaactaaccatatgacgtttatagcactgggaatggcttggttccagcttaagcatttatacctttgtttccctccagtgttgtttagactctttggtattttttttttaatatataatgacttaaggttcttacctaacagaagcagccgatattaagaagaggtggcaagaatacacagaagaactgtacaaaaaagatcttcacaacccagataatcatgatggtgtgatcactcacctagagccagacatcctggaatgtgaagtcaagtgggccttagcatcactacaaacaaagctaatggaggtgatggaatcccagttgagctatttcaaatcctgaaagataatgctgtgaaagttgctgcactcaatatgccagcaaatttggaaaactcagcagtggccacaggactgcaaaaggtcaattttcattccaaacccaaagaaaggcaatgccgaagaatgctcaaactaccacacaattgcactcatctcacatgctagtaaagtaattctcaaaattctccaagccaagcttcagcagtacgtgaaccatgaacttgcagatattcaagctggttttagaaaaggcagaggaaccagagatcaaattgccaacatccgctggatcatggaaaaagcaagagagttccagaaaaacagctacttctgctttattgactatgccaaagcctttgactgtgtggatcacaataaactgtggaaaattctgaaagagatgggaataccagaccacctgacctgcctcttgagaaacctgtatgcaggtcaggaagcaacagttagaactggacatggaacaacagactggttccaaataggaaaaggagttcatcaaggctgtatattgttaccctgctcatttaacttatatgcagagtacatcatgagaaatgctgggctggaggaagcataagctggaatcaagattgccaggagaaatatcaataacctcagatatgcagatgacaccacccttatggcagaaggtgaagaagaactaaagagcctcttgatgaaagtgaaagagcagagtgaaaaagttggcttaaaactcaacattcagaaaaactaagatcatggcatccgatcccatcacttcatgggaaatcgatggggaaacagtggaaacagtggctgactttatttttcttgcctccaaaatcactgcagatggtgattgcagccatgaaattagaagatgtttactccttggaaggaaagttatgaccaacttagacagcatattgaaaagcagagagacattactttgtcaacaaaggtctgtctagtcaaggctatggtttttcaagtggtcatgtatggatgtgagatttggactataaagaaaaagctgagcgccgaagaattgatacttttgaactgtggtattggagaagactcttgacagtcccttgaacagcaaggagatccaaccagtccatcctaaagaagtcagtcctgggtgttcattggaaggactaatgttgaagctgaaactccaatactttggccacctgatgggaagagctgactcattgggaaagaccctgatgctgggagggattgagggcaggaggagaaggggacgacagaggatgagatggttggatggcatcaccgactcaatggacatgggtttggctggactccaggagttggtgatggacagggaggcctggtgtgcttctgttcatggggtcgcaaagagtcagacacgactgagcgactgaactgactgactgactaaaggttcttactgagacaggagtaatgctctgtgcatttatccccttcctacaagttgggctgatcatctagaaggcaaggagtgttcacttctcctgttccttcccctacaaaatgcccacagtggtgttcttaggatattctgaagccagaacgctatgtttagattcaagttggaaaggccatgtggtcctctctccctctgtgtatctctggagcccatcattgtcccttcccccattttcccttctaacccactgcccctgggtctggctggccaagcctggccctaacctggcagaaatattttttagtcacatgagatggggtggggtgaggtttgtgggcttcatggtgtgatgctggctccagacaatttgcctgaaggaagttcaggccctagagaactaggtccttcgggggtctcaggtcacatgaagttacacccagcacgggaccctcctgccagttgggctcaggccctgcctgctggacccggctgcatggaaggtgtggcttgggtcccttgaccacagtcagcgagcctggctgggcaggcgctgtggaggggtggaggggaacctggcaggcccttcacgggtgccctaaaaaaggtacagatcagccatgtgaactgagagtcatttataaaaagaatattgcagaagtagtagctgaaactaaaaggtgacatagtaaagattagtaaatatattttcatcttcattcatatgtattttatttttctgtcctcaacacaagcataagcagtaagtgcactaaataaaaaggagcagtatttgtgcctatttccctcggttggctgggcctggctgccagcccaggataaatgcatacacatgccctctggtggagtcattcttgacccacttgcccatcttgctacgtaaacaggctttcagagggcacctgggtttggggtgttggtgctcccatcgagaggttctgtctgcaggggaggctcactgggcatgttgctgacgtcagctggtgccctgtgggtccccaccaagggctagttcccagaggagagcaggatggtccctggggtgctgaggttgaggggctctctcgttgtagccgctggacagccgggatgctccggcgtctggttcctcgaccgagctcggtggggccctggggtgctgggttgcctccagatgcagagcgggaggttgaggccaagattccaggaacatgttgggggctgctgagtggcgttcctgtggacagagcagatgggagaagacgtccaagccaccaaaggaagggtccttcctggggacttcctgcctggccaaagcctaaggaggaggttctccccaggccagagcccctctgccaggggagcaggcccgggggtggggtgggggtcagcttggctcaccgaggttacgtcggtggagaaatagaagagagaagtgctcaatggtaaccttgaccttgggactttccctccgacctggtgtgtccattcacagctgggaggcagggagatggagggggatctggtcgatcttccgtccacccatgtggttgagtgcagctcgtcttgtgtctcagccagagacacgttctccctggatggaccctcctgcccttgaggtgccgtggcagtgggcagtccgcctgccttcggttccatcagtgaaatgggatgacagtaacaactgcctcgtggcatcagggtgagaggagaccatgaattgataggtatctaagctagagaactgggccacacgtggttacaactgtaatgtgaatgaagagggtcaggaagggacgcgcagggaagcactgccaccttccagagggcctcagacgacactagcatgatcttttttgttaaatagtttttgttttgtttcagcacgggaagaatgcctctttgggaagcaactcactattctctttctcaaatctaacttaggaccccttggccctccccgagtgaaggaggaaacagaacaggctcgatcttgaaagcaggactcccatcgtgggcctgactgtggactttgagctatatgctcagtatctatgggaaaccaggcccccggaaggaagagccccagggctctccatcgcctaaaagaataccctaattatctgtgtaactgaatagaatcatacattctattatgcttattggggtatgaccacaggcctattgataattgtccactgttaactacctaggcttaaggcatgtgaatcacaggttaactttgattgtatctttcttttcctttgttcagtctagtttcagggaatttggggaagtgggtttgggcacgtacacttaaggtatataaagttttcacaaaaactgatcgggctccttggctaagaggagactctgccttgggcccgcgggtataataaactgcactccactatctgcattgtccttctgagtgagtttttttctgggaatgcgtggctacaacagggagcattccttgtctgtcacgaagtccctggagagtgttttgtttagcaagccacgtggccggtcaggggtggggagcggggaacagtagctcaggagatgggagagacccccacgtgcccactggaccttggaaccttctgctgggacaggagctggtggtccttagcacagggctggctccaggtcacctcagaagagtagaagacagaggcaatttcttcggctggtttgtcaggatgtctcttgagggtgaggacctgcttagcttcagtgtaagctctgaaagctgaaggactaggtctcctcgctgctccagacctggtccccgcctcccacttgcgaccgaggggccctgaaagacctggtgggtgagacactgtggctgggcgggtggcggaggggctagaagaaatagagcccccccccacccccaccgaggcaagcctatgcatcttcagagcctcaggagtctggacgtgagcccccaccccacccccaggcacaggggctgccctctggttccctcagaggcttggagactccttttcccttcctctcagaacagctctgctcacctgtccctgcccccagcttcctgtgccgactcctggttcccactccccacgacttggtccagaataggggcccagccctccgcccccacccccgccccccaggtcttcctctggacacgccagtgcctcctgagcccagctattgtcctgccaggccacacatttccaagggcagtggctagccctcagtcaccctctctgggttagttgcccatccctggtcccatcagctatggcagggagaccggtggtatagagccccttggaagcatcattcttaggacagcggtggctgtcttgggtggattaagccagaggaaaattgagtgtgggaggccaactgcatgaacacaggagggtgaacgtctaatgagctcagctctaattactgcttggaacgcgtgggttgcctccagttgaaccacagaggtacacagtaggcatctgacaacagaaggtggccgtagatgagggtcttcgctttcctggtgagctggtgacctgattggcacagggtcaccttggcttcattatctgcagcagcttaatggaggtatgttctatacataacgaagctaaaatgtaaaatccagccatctttagtatgttccctgagcagtgagaccattaccacgatcgttgaaagaaaccccctacccctgggcagtcaccttcctttgcttctccccagccctgggcaaccactaaatcttctgtctatgagtttgtctcttctgccacatttcacatcaacggagtcacacagtgtgtggcctttcgtgtctggcttccttcacgtagcacaatgtttctgaggttcatccaggtagcacgaatcaaaaggctttattcctttccatggccaaaggtattctgccttggacatggtggccccctgtttagccacacacccccgtccttaccttgtctgtggagagcctgaccaggacatgtagagaaggatgaggaagagaaaaaccacgaaagctgccaggctcacccagaaggcgatgacgatcgaatctgtgggtggggacatacacgtcgacgtcagtgtgagctcacgtgccccacggtccccacgtgctgcggaactggggctctgggagagacccttctcagtaagtggccagtgagaagattttcccgtcaataaccaccttgagggacttccctggtggtccagcggttaagaatctgcattccagtgcaccgtgtacatccctgtgtgctgagtcgcttcagtcgtgtctgactctgtgtgaccccatagactgtggcccttctggctcctctgtctgtggagattctccaggcaaggatgctggagtggggtgccatgccctcctccaggggatcttcccaacccagagatcgaacctgtttcataggcctcctgccttggcgggcagttctttaccactagcaacacccaatgcagggtatatgggtacaatccctgggcagggaactaagatcccacgtgccacagggcagccaagcctgctccagaagtagagagcgttgcgccacagcaaagacccagcacagccaaaataataataacaattaaataatactgataaccttgggaaagaaagaggcagcagggacttggcttttttcccagagagactagtcactgggtcagtttagggtgatgactgaggggaaaacagtaaatgaaactgggttcccatgccaccaccaccacccccgactccggacttgattttttggctgcttttgttgctcagagtgggtcttcccctcttccttcctcccaggaaggagaagaaagtgctgtgagcaatttcatgtggcatgacagcctcctctctcctgtgaggactgcagcccctaccaagagccttctgcgatcagctcagttggggaccgcttcaaagaccccaagatcagagacttagaaaaatgatatgcaccagaaaatgctcctaacctgctccggggagggccaggctgtggagatgtcacccaaggctgcccggccaggctgcgggaggtgaaaagacatggtccctctctttttggggcacagggccagctggggagctgtggcaggaggaaaaagcaccattgcagccaccactctggctctatcattggctggaggtgaaaacacgcaggaaaatcaggaaagatgctcagcctcttcggggccctggtagaacctggtggaacctggccgtttagaggtaactttatccagggctctgggtcaaaacattcagcaagttgctagggaactgtaggaatgtgtttgtttctcttgtttgtttctatggctctgggcccagagttattgttttagtagctaagtcgcgtccaactctgtgaccccatggactgtaacccaccaggatcctctgtccatgggccttctccagaggatcttcctgacccagcgatcaagcccacatctgcattgtgggcagattctttaccactgagccaccagggaagcatactgggttcataattagtgtctgcaagtatcttatcccagacacactcttgccccaggacagatgccccagactgagatatgctaggcacctacgtgtatgacccaagaaagccactgaaggacggtaatcaacaggcatgtattaatctcttatgcaagtcatgttttgctttgggctgttaattatccttgcccaccagaaatcgctgaccccctttagggttctgcatctgtccaccagcatcctcctcgacactcctcctacaaccaccagcactagtcctgccctgcctcctgttcaaacaaacaagatttctgtgatgtattcaggttaaaaagtgccataaatagataaataaatgaacaaataactaactgaatggataaatgattagagatgtatggggtaaatagtagtcattgagtaaaattgttgcctctgcctctatgacccaagacagctagagggagaaactaaaatcttatgagttgattttaaatcctaaaagtgtcaaaaacaggtaacaaggaaaagatgcggtattggcaaaaggcctcatggacgccaccaccttgaaatgtatcagcaagttggcactcacactgcagagaggcaaggacagcagagcccctcaggctgactcacaccctctctgctttctgtccctgatctgagacatggctggcctgccctgcagcatcacactgttaaaggggatgtacgggctcctgggaaacaggaaatgaggttgctgctgtctgtactaagctttttttttaatttttaaaaatccacgatctgggataagaaatctacaaaatgagcctggaacatcttgtcttccagaaagcaaaaaagctataaaaacccaaacaaagcaagctcctaacatagccaaatgtgttagtttcaggtgtacagcaaagtgagtcatcgcgctctctctctcgctcgctctctctcgctctctctctctctctatatatatatacacttatatacatacatacatatacacatggcttccctggtggctcagctggtgaagaatccacctgcaatgcaggagacctgggttcagtccctgggttgggaagatctcctggaaaagggaacggctatacactctagtattcttgtctggagaattccaaggacagaggagcctggcgggctacagtccatggtgtcgcaaagagtcagacacgatatacactgtttcttaaattcttttcctatataggccattacagagtattgagtagatttccctgtgctgtatacagtaggtctttattagttttccattttatgaatagtagtgtgtgtatgtcaatcaaaagaagcctctgactttcgaagtgttccttgcctgttcactgtgtattattccccagaacctgctttaattcaactctgtcctaaagagtcacaatttattgtctaaccctcagagtataagagtatatatgttctcagaaaatttggtttgggagttctaatgtttaaggaagtttcagatttctgcagacactaatgctcttcttctttcattaagaaaaaaaaaaaaaaaacaatgcaggatttgagatctttggtacctagataagttccatcagagcctcaaagaaaacatcatcagaaactgagcagttgaaacgccctttcccctctcccaggctcactctgtctgtcctagcccttggtcattatctccagatgctgagcaggaaatgagatgatacctcttcagaacacagagtcttccgagaagtgaaattttaattttgtcagaccaaaagagcgaacagcagacaccagccgcttcctgcacggtgttctctttcatcatgtgcttttgaaaaaggcagccaagaaaatagggtttttccctcttcctcctgaagggtcagcctaagtgcttggaaagaacattttgttacaaggacaagagctgtcattctccagggtgggaacagtttaaacaacccttgagtttgtctttacaacaaggagcaccagactggcttgacaatgaaactggttcagtcatggaaaactcctcttcccttccctcttctctagagtcccaggagaaagttaacagcaagatttttcccttcctgggggataaaaatggggttaagagcctagaccctggaggaggtcaattttgagttcaaattctgacttgactatttccaagctttgtgatctcaagccatctgagatttttacatctctaaatctgtttcctcatcagttaaatggggataatagcgtgtgttatacaggctgttatgcaaattaaataacatgcatatgtaatgcccatggcaggatttcctcatttaatggttgtgaaatgatctgtacacagaattaaaatcattatttctgttaagagtgttttgtggcaagtgatgtcgctgcttccttcaagctccctaaaacgtaagctatgagtaaaggtaattgttcttgtcaatccttcacctgcttccatagtaatagaactcctcctgtagctaggcacatggctgcctgagataaagactatatttcccagcctccctttcagttagtatggtcatgtgacaaggttctggccaatgagatgtgaatggagcatttgcaagccagcttctaggaatcctgtggagatggctagatttctaacacatgcatccctttgtattcccttactctgttttgctgcccagaacatggatgtgatggctatagccaggattggaacatgatggtgaggacacatcccagggatggcagaggtgtgagctgaaacaaagccagtccttgaagacttcatggagctgacctaccaccctgccctgaaaacttttacatgagagagaaatcagtctgttttatctggtattccattaatgtaaccaattttctccattgaatctggacaaaaatcaataaatgacttcttaaatgaacataccaaaactgacaattccaaataaatgctgactttcaaaataatcatcctctctctactgtggtggtggtggtggtttggttgctaagtcgtgtcagactcttcagacaccgcggactagagcctgccgggctcctctgtccatggaattctccaggcaagaattctggagtgggttgccatttccttctccaggggatcttcttgacccaggaattgaactcaggtctcctgcatggcaggcagattctttaccgactgagctccgagggaagccctctctactgtagagttaggtaaattttctaaaatacctatattgatcaaacatttataaattatacttttggaattaccttcaaggatacacacacacacacacaccaatcttgccactttatgagatcatatcctttttttttcttgagatcatatcttattttcaatacccaaatggtaccaatcacttaatttcattcacctgattggtttatgggtgattctaaactgtttcccagaagcaaatccaccttccaaagaaatacataatgtatcactgtggacatttcatagaatgtgtcagggccaccaaagtcagttccaaaggacgagtaccaagcaggttttgaggaatgacggactcattcaagtatgacagctccacacgaggctagcttgatgggaaatttgttccaagagcacattctcaatctttgtttaaaaatcgctttcactgcttacatcgcacccatggaactgaccatctgcagaaggcttagacatcataataaaagttgtgggacttccctggtggtccagtggttaaggatccacctttcaatacaagggatgtgcattggatccctggttggggaactaagaccctacatacttgcagggctactaagcccactgaaactagagagcctgggtgctctagagcccgtgatcctcaacaagagaagcccagttgcatgctgcaactaagtgccacagtgaagacccagtacaaccagaaaaaaagaacaagttgtttaacctgactgaaagagatgaatagcatcatcgactcagtttgagcaaactctgggaaatggtgaaggacagggaaacctggcatgctgaagtccatggggtcgcaaagagttggacacgactgagtgactgaacagccacaacaacttgaacttgattgctctgaccagaagagaagatttatagaaatcaatctttaccctaaagtctattcactgtgttcagatgaaattggttagtgattgttcagaagagattggttagtgatgtgtttttgttcttcttctcccagctgttggagaagcagatgaacagactgccttattattgaagctgccagaggcagtgcctcagcagaagtcagtgtgggctatgacaaattttttctaactggtaattaaaggaagaagacatactgacctaagaggtaaataataccaggtaaggccaggcactacccaagggaaatcagtccgcctccacactccctgcaagggagcattcaaccagtatttggagactcattgtattaacattatctgtattgtcactgtaagatgggaatatgagattgtcttttttttctccagagtttagcctctgaaaaaggaacagaatcaaatgtggaatccgtttgttcaggcagggtctcaggagacagatttctgttttccaactttttgacagtattagggagattcttaacatttccatgaaacagaagccatgtctgaaaatcacaggggtgacagtctttgtgaagtccctgtaacagaatcacacaccagatttcaagccttccctgaggaagggcaacccacagccttcaactcagcgttgaaggctcataaaaatgtgtctgcatcccgagatctttccaattatccgtccaaccatgatggaataaattccaccatctgggcatgaacacaaaaatcttaaaatccttcctgcttgttaggttaacacatgaacttgggtacttttttcttctatttttgtctttttctcaacttgacataagtcaaacccaatctggccttcaccatgccaacccgctgccccaggggaccttctagtgaggtggtctgagggagagctttgcctctctgtctccccctaaagcattcctggcatctttctgtctttcatgtgcacagacctggggcgtgacggtttgtgatttgtttgactgggatggagatccaacccagagaaactggcaaggagagaaagttgcatttgtcagcaacggaggtcacctgccttctgtggctgacctctgtccaagctcacctggactcacacctaccttcctctaccttcaaacccaagtaacagagtgagagggtaacaggcaggaaggccaggggtctccaaagggaggaaatagcctgcaagtgtcagacatttttatctctcttaagcggcaggaggaaacaaactagcgatattttttccttctctgtacaaatttaaaaggaggtttctcttaaaatactgtgttgccataaggacacctggtttcgcctgaaggtaactattctcaaacctagagataaccaaggcctttttcttatggaaatgtttgtcttaagctatgctaatgtactatgcgtttacgccagactctgtcttcaagtcggttccgcctcttggctcagaacctacttgacaaaccagtatgttatactcagatattgttcccctaatctatgtaaatgaagctatttgtatggtggtctgcccttcttcaagattcaagttaataattttatggcccaggttgaaccatttggtgccaagattatcccaaaatgaatcttatgggtgaggggcctcatgccattctgagttttaagacattcctttctttcattaacagactgctagtgactatatacagtccatggggtcactaagagtcggacacaactgagcgacctcactttcatttttcacttttatgctttgaagaaggaaatggcaacccactccagtcttcttgcctggagaatcccagggacgggggtgggggtgcctggtgtcctgccgtctatggggtcgcacagagtcggacacgactgaagcgatgtagcagcagcagcagcagctcgtatttctatttttttttttcctgttgatggatgggttgtgtggacttatgaaataataaggtggtttccattttaagagaaaaagatagttttcaaaagtagctccccaaaatataaggaatagtcactgcagtctctttgtcattcctggaatataccaggcactcctctgcttcagagccttggcccttggtcttcctaaaaggttccttcccaagacatcgtcaagacttaatctctcatctcttcacaggccacaggtgaggccttcaccagccttcttccacccttgggtccccgctctcctagccacctttcccatttgatttttctttggagcacatcttgccatctgccatatttttcttgtttatggtgaactgaaaagactgcctccagtttgttgttttgcttatttttggctgtgccacacggcatgcgggatctgagttccccagggagtgaacccctgccccctgccctggaagcacaaggtctgaaccactggacctccagggaattcctctgcctcccatttttaacccttcttgcactggaacccatctaattccctcctcctgaatctggcctgggctcaccagcttacttacccaagacacagagctagtaagtggcagagttaagatgtgaattacagccaacaggcttagagtccatgtacctagactcgacagagccactggtccatggctggtcacccagaaaaaaacaacaaaaactagacaataacctattcaaggtgcaaacaccccagcgggggatggagttttgcctagccccaaatttctttcccagagacaatagaaataaaaatcaggacatgaagcctgggatatgtgagacacaaacaggagtaaaggggcccagaaaaagcacctgtctctgtggatatcaaagattcctgatacctgggacttgggtataaaatgctatttggcagcctttgtgataaatttagaattaactttctaagacacttttgtgatacactgtatctttctaagatacttttgagaccaaatattcttttaagatggatttccttttttctcaataaatgagacttaaaacttttttatttgtttgtttgtttgtttttggccataccacatggcttgtgggatcttattatatccctgaccaggaattgaaccctggaccctgggcagtgaaagcacccagttccaaccactagaccaccagggaattcccttaaaatgtatttcttaatagagtttaatgtatttgtttggagttccagtaagctaggtaggtttcttcaaattgtagatatcatgttttctatactctgtatgcagatatgaaagagctatttagccagtcccctaagatgtataacttgaatactttctataaaaataccaattgatacttacttttcataggagggacacagagcctggcctctccctgtgagtgtcaaaagtcctcaatatctaggttgtccagggtggggacagtgactggtctctctggcaagattccttactgaaataattgttattgggtttgggaatttgaggaagaacttatttgacctcatatctagttccccaggttgtaaatgtccgactctagttcaaagtgcaaaaaaaaaaaaaaagaacatctcaaacctcacacacaatttagagaacaccagccattttccccagaaatgtaaattacctgtgggtaatgggcaggggcggagattgagatcgtgtgttctaagctcctgaagttgcaaacagcctcccaacacaaagcagcggggatcaactttggagcccaggtgatgagtgaggtgtcagaagccgagctagaattttatttaatttgtgctcattttaaaaagtccttcctgaatgcatatctatatgttgtccaggtcagcatggatcttgaagttctgaacttttgataatatctgtgagtgggcttttatttcaaatctgccattttctccctattactctatgtcttccatattgtgagttacatgtgaagaaactgcattttcatttcatgggtatatagcttgtatcagaaaacacaccaaatctattgtccccccaaaagttttgctacagtgtcaggaatacaggaagtcctcagcaaacatgaaacagaagtccttcacttctggaaggtggatatgacacaggaaacagaacacttcctgaccagacattctataggactttccccaaggaccctgccagggctctgcctccttttattaaataataccagtgatgtgaatttcagttttgagctggtttgtaacagactgtttcttttcatatgggaagtattgtgttctttctaaggacgcatttatttttgacagacattatgtgtgattgtagtgaagttcctgaaacctgagggacttcaggataggcagaaaggatgggttcccggaactttgttttcattttgttttttatgctcatttcctcatctgacttgttatctggtctgagtaactggaataatcagagaagattattgagaaactaccgagttacttcagagataaagactgggcagattaagatgaagaaaaggctgttaacttgtctggtggtccttcctgagaccatgaagatgaagcctcgctgggtatttttaataagaattagtcacacatcttagaagtgaacacagtagctctctcccacatctacatggagacaacagaaaactcgaaatctacagtttgaagaaactcatctagttactggagccctagacaaacataactctatcgagaaatctgtcttacccgtgtagtctgcccccaaagtggcttagtttctcaagaggctagttttcaacttattacagaagataatagatacaccctccattcccttctgtctatgagttcagagtcccattctgcctttcccgtgatatcccgggattcataagtgaatggagaaaagccatttgcgccaacccccagcctctgatgggccggcttccccagttcaggactcacgtttattggctctcagcttcttctcatccacgggcatgaggtccaagtagtccaggtagtattcgtagctgtagtacggggcagagatgttggttctgttggccatgcctgcgtcgctgcccggtggcccttccggagctgctccgagctcgccaggagatggccccgctgatttgtgtaaaatcatccaagtatgtctgtgggtctctgaactcaaggcctcctcacttatcagagctgtggggctgggaggaaggtcggggggtgggcctgacatctttagagttcaagtagagcaatctatcccgcctggcttgatgcagctccaaaacaaacagagtacgaggcgggagcctgaggtccctgtgcaagtgctggttggccctcagcatccagacaagaaaacagattccctccaggaccctcgaaagataagatgtggactaggactagaaagggcaaccactttgggccccaaatcattaattgaaccaaatcaagagcctggcattgccaggcttagcttgcattaaggcagctcttggtaccgttaagcaaccagcaaatcactggcctagatttcttatctgagggtggaacctgagtgatgtcagccttgaacttgcaacctctgtcatggacacatcaccacttcattaaacccaaagaacaccctgctccaagggggtgcacgtcccagctttcatgtgcgcttccaagaaccaagcagtcagctgcctctgttcagactggggaagctgttttccaggtcaagaacccgcatggattgtgttcttgggaaacagggccccagggttaaccagtccttggctgatgacagactccacaaggattcatttggtcagggcctgactccaagttgtacactcacttttctaagagcagagatacaagcaagaggagcattccaagtactggaaatgagcaggactaaatgtgataagctccctaaaatttagcttttgagaattagtgatgaagtcaaaacacacactgtcacggggactttccctccaagatcctgactttctagtcttcttgactcaagtctacagtgccagaggaaagctgggcattgatggtgtaggcagtgaacccagataaattcaggccacctacaaaggtccatgtggtcaaagctatggtttttccagtggtcatgtatggatgtgagagttggactataaagaatgctgagcaccaaagaattgatgcttttgaactgtggtgttggagaagactcttgagagtctcttggactgcaaggagatccaaccagtctggcctaaggaaatcagtcctgaatattcattggaaggactgatgctgaagctgaaactccaacacgttggccacctgatgggaagaactggctcatttgaaaagaccctgatgctgggaaagattgagagcaggaggagaaggggacgacagaggatgagatggttggatggcatcaccgactcaatggacatgagtttgagtaagctctgggagttggtgatagacagggaggcctggcatgcaacagtccatggggtcgcagagtcggacacaactgagtgactgagctgaactgaactgaattaaaggataattgctttacaatattgtgatggtttttgccatacatcaatggcaccccactccagtactcttgcctggaaaatcccatggacggaggagcctggtaggctgcagtccatggggttgctaagagtcggacgcggctgagcgacttcactttcacttttcactttcatgcattggagaaggaaatggcaacccactccagtgttcttgcctggagaatcccagggacggggaagcctggtgggctgccatctatggggtcacacagagtcggacatgactgaagtgacttagcatagcatagcatagcaatgtgaaaaactctcacagacacacccagagacactgtttaatgagatatctgggcttctggtgacgcagtcatgttgacgcagagtaacatcagccttccctccttccctgccctctaccccctcccctttccccctctttctccttcctccatccctccctccctcccttccttgatacattttccaattgaacacactttaatttcatcagcttgaaattttcacttcagacaaaacaccgattgttcaaatgaattcattgattgctctggtaataatcttgacttttaaaaaccccatggaatttccctgctaggaaaacagatttaaagcgtgttttctcctttgacataagtaagaactaatactcccatcaaggtcagctctctgagataacaatgacatgttcctattaacaaagacctccaagaccttgacagttggccttgcttttcttctcactttaatttataaacccaaactcgaaggtaaagttgtctttccttccgtgttttcttttacaggagatgcgcacacttgttagctagccttgtggccgcagaccgagtacagggcagaaggtgaagagaagaaaggggagagcaaacactggctgagcagtgcctgagctggctgctctgctctgtgtttcctgcgattctcacaatactctgctcggggattggaagcctcttttagggggctaacagccaggtaggacagcctccatgctctgcccaggacaccttgaacttgcagactggtatgcagtcatgttatgtggttgccatgacagattaccacagacttagtggcttaaaataacatagatttactatcttacagtcctggaagtcagaaattcaaaatgagttctggggctgaactgtggagttggagaagactcttgagagtcccttgggctgcaaggagatccaaccagtccatcctaaaggaaatcagtcgtgggtgttcgttggaaggactgatgctgaagctgaaactccaatactttggccacctgatgcgaagagttgactcattggaaaagaccctgatgctgggagagattgaaggcgggaggagaagggacaacagaggatgagatggttggatggcatctcgatggacgtgagtttgagcaaactccgggagatagtgaaggacaggggagcctggcgtgctgcagtccgtgtggtcccagagtcaggcatgacttagtgactgaaaaataataacaattatcttacactcctggaagtcagaaattcataatgagttctggggctaaaatcaagatgtagccaagactgtttccttctggtcaccctgtggagaaatctgtgtccttgccttttccagcttctggaggctgtcctctttcctttaaaaaaaaaaaaatatatatatatatatatatatttaatatctatttatttggctgcaccaggtcttagccgcagcaccctgtggtgtgcctaactgttaggtgcggtgtgtggggtcggacctggccccctgcattgggagtgtggaaacttaggctctggaccacccgagaagtccctgtcctcattccttgacatgtgtttcccttagacctttccgttgtcacgtcaccttctttttctgcatcaactgtctctcttcctacctatgaaggtacccacgccattttgaccacccagacaatccaggaaatctctccatccagaatctggagttcagttatatctgcaaagtctctttttgccatatgaagtcatattcacgggttccagggattagatgtagatattggaggcgggggactattattcagcctgccacatggggcaaacagtgttgtgggtatacaaatccttaaacacagtgcctctctctggggtatccgttgttgtcaaagatttttggtaaaaagttactttttaatatttaacaagcatgggtatataacagagaaaattcaaaattttcatgacttaaattattttttatcataggcaattttaaacttttgcaaaagcagcaagaatagtatttcaaaactccatggaatcatcacagcttcaactaccatcaagtcctaagtaacttggcatctgtagctccattcactcccctcattctggactactgtgtagcaaattctaatacatcatttcatctgtaaatatttcagtatgtatctctaaaggaaaaaaaaatttttaagtaaaaccgtggtactgttatcccacctaaaaatagttaattccatcaaacatccagtcaatactataatttttccagtttgcctcataatttcttttacagttatttgttcaaatcaggaggaaatgagttgcatgtgttgccgttggttgaaatgactctcaagtcttgttaaatttgtaggctccgtcttcctcctacgttttttaaaatttggaatttctttgttggggaaaaagagttatcaactctgaagagtctgccagttagagcccacgttgtgttagtcatgttccccattccctgcatttcctggaaagtgaagttagacctagaggctggatcagatttaggttcaattttttattgacaagaatacctcatcggtgttgtagtgtcctaccttcaggagacacataatgtctggttgtgtcttttctgtgcaatattatcaaccagtgatattcattgttgagatccattgaaaagtgaaagtgctcagtcgtgtccaactctttgcaaccccacagattgtagcctaccaggttcctccttccatgggattttccaggcaagaatactggagtgggttgcatttcctccttgaacccaggtcttccgcattgtaggcagacgctttactgtctgagccaccagggaagatccattaaatatagtaaaaatgatgatttctcttttttgtgtgtgcccacaaggcttacaggattttagttccccaaccagggatggaacctatgtcctctgaaaaataaaaatcgtgatttccttattccatcatttctttttcacttattagctaccatccttctaaataaacaaaccaaaaaaggaaaaatatctttgtttatgaactatctggttacctcaaatacagttcatatcaaggtgggataaatgttgatttacttcttctatttgccagttttcaaaataatagctgggctttctagcatcgttcagcagtgaacagtgagaggttttgtttgttttgagtgtgtgcaatgaagccttcttgtgtgtcccatccgttacagctactgtctttaccaaggcacagtttacctcctatttggagagtgagagcctcctcatgttggttatattggaagtttgctttgtttgggttctatagcttttttgctttttggaagacaaggtgttccaggctcattttgtagattttttatcccagatcgaggattcagccatttctccaaggactactggttttttagtgggaaatattcagctatcataatctggatgttaaaggtggtaattgctactgagttggttagtgttaaggcctattcaacctagagagataggaattgtttattctttaaagcaaaaaaaaaaaaaaaaaaatcatgagttcatactgatacatttttttttctattttaatttttttcccctttttctcatatgtgctaagtcgctttagttgtgtccgactctttgtgaccatatagaccatagcctgccaggttcctctgtccatggccttctccaggaaagaatactgaagtgagttgccattccctcttccaggggatcttcccaacccagggatcaaacctgcatttcttgtggctcctgcattggcaggtgggttctttaccactagcgccacctgggaagcccttttctcatactgatacttttaaattcaaaatcatcaccacagaggctttccttaagcttaacttccgtagctgcatctctttttcccaaaacttaaaatcctattctccccaagtaatacttaatcaatacacaatgcatacacagtctcagaataatgtgtgcttaatcgctcagccgtgtctgactcttgccaccccatggactgtagcccaccaggctcctctgtccatgcgattctccaggcaagaatactggagtgggttgcaatttccttcgatccaggaatcaaaccggggtttcctgcattgcaggcagactctttaccaactgaactatgagggaagcccttagaataataatatcaatatcaataagaacatgattactgaaaacaatttacgatcttttgtgaggaggcagggatttttgtttgttttatttgtttttgcttcttgttttggggtttttttttttttttttggtccttagagtatctccatcaaaatatatctggtcaaatttatttatttatttattttggtcatactgagtggcttttgggatttcaatttcccaaacagagatcaagccaggggccccagcatgaaagtgccaagtcctgaccactgggtcatcagggaattccctcaacttcatgttttaaagtcacttaaaatagttctacctatgaagttatgccaccattaaatatattagatatttcaatatgtagagatcactttttaaatatttagttttatggttatgtaatatttattcttatatttacatgattccaaaatagaatattacaaactaaggtatatttgtagacaaattcctttctacagagcttataaagtctgtattcttactgggtaggaaactgcctgctttcctgcacaatagtctgggcaacaaattatggtgtcgaacttttgaattttatcaatctgatagctgaggtatttgttttcagtgcagtcaaaaaatgaatgtggtagagaatatattaaaaatattaaatatttgcttttctttaactgtgatggacatgagtctgagtgaactccgggagttggtgatggacagggaggcctggcgtgctgcaattcatggggtcgcaaagagtcggacacgactgagcaactgatctgatctgatctgatgcatgccacattccttgttgcagcacatatttgaataagaaaggatatgttcaagatacattttaaaagttcagttgaacttccctggtggcgcagtggataagaatccacctgccaatgccggggactcgggttccatccctggcccaggaagatcccacatgccatggagcaagtaaacccctgtgccgctgctcctgcgtccacgctctagagcctgcaagctgcagctactgaagcccgctcactctagagcttctgctccacaataagagaacccattgcagtgagatgatcacacgttgcaaggaagagtagttcacactcgtagaaactagagaaagcccacgcaaagtaatgaagacccagtgcagcccaaaatagaaaataagtaaataaaaatgattaaaagataataaaagttcagttatgtctaaaaatgtccactatacatggatcaagattacagtgataagcgattccaacctgaaaattacttgccctctaaattttgaacttctccagcttctgaaattgagctgttgatgaggagtctaaagccactctgattcttgcacctttttgttttctttgaaactttggaatcttttctgaaggttgaagttcggatattttacaatgctaagtcataatgtgagattattttgttctttggctgggcagttggtatagcctttccatctaaagagtcacatgtttagctgagaaattgtattattgtgtgtgagtgtgtgttaagttgtttcagtcgcatccaactatttgtgaccctatggactgtagcccaccaggctcctttgtccatgggatcctcctggcaagaatactggagtgggttgctattcttttgattatttgttctccttcattttgtctctcctgtgtgtttggactgcctgttagtcagatattgggtctcctgcattgattgcttatgcctcttattttttcctcaccttttatatttcttaggtattttcctatattttcttcaatgtgaattttctttaatgttaccttccagtccttctaccatagatgcaacattgcctcaaatctcttgaaagatacataagccatactgtgatactttaggtctctgccatattattccagatccaggagtcacaatcttcacttttggatcagtctgtgttgcgtttagatgtttggtaggtttgatgcagtttataataaaaactatttcccaagaccttcctctggttatataccaaaaaaaaaaaaaaaagaaaagaaaagaactgggggaaacaaaggagtgcttggaaagaaaccaagagagtgactttagaattgtatactggaaatatattcttcccttatattgtcattctccagagttagcccccttgagagattatagcttgaatgcctcaaggcattatcaaatgtgaaaagtgaaaagaaagtgaaagtcactcagtcatgtccgactttttgcgaccccagggactgtacagtccatggaattctccaggccagaatactggagtgggtagactttctatggggtcacacagagttggacacgactgaagcgacttagcagcagcagcagcagcagcatcagactttatcaaatgtatggtgttatatttcaacaatttggtgtagtggtatgaccactgtatttaggagcaagaaactgaggttctagattggaatctgtattttaggacccttaggagttagtgacagacacttgattctaactagcttaaacaccagcggggtttactgggagcacgttgagaggggtgcccacagaactgggaacagggataactgaggtactgctgttactctcgatctctgcctcacatcttgcttctccctgaggatcagagtcatgcaggctattccacagagctggatacctgactgatgacagttctgggctcatgattcaagaggaaggggtgggcagattctctcccaagctttgacctgaagcattccaggaatggacttggacaggctctcctttggacacctggctcacctcgaaccagtctgtgtggccaggaaggtggtggctaagactgatgtgagcccacctctgggataggtagggtgagaccttcaagatggggagcccctctgcagccacactgttggagtgggggaggggaaacagcgttcccaagaaaaggagaacaacgctggacctgtcatagcccgaatgtccaccagtctcttccactaacctgagccatgacttctgatccaaactgaatctcagctcatctatttgcagagtaagacgtgaggatgaagcatctctgtggttcttttccagctcaaacacatgcttttgctgaaaaatcacaagtccgtctccttattcttttttaacttgcatgagaattaaacatctctgttaaagaccgggaaatcgtgattcctcacattaactaggagagggaaacagaactatttaaagaatgtcttgcctctgacgactttttagaaggtgcagcatatcgctacagttactgtttcacccccggaacacagatataaatatctacctacccttttcccatggcgtattttatatccctaaagaggctctgattgtggcagaaggtccctgggggctgagtgtggagcatggctttctctcagtgacagctggttggggaaggcaatgcaagtgacatttggctcccggacatctctactggtagcagttggaccaaacacccttgaaatgcagctgcaaccagctctctatatactaaaggggccagctggctgactccaaggacctgtaatcactccttattgtcactctatgtgtaaggaagtgcatgcaattaacatctagtccctgattgtaagtggatgccaataatttctgattttcccaattgctagagtcataaattttttccatcaaaactatcagggtccaggtaggaggaggaggaggagaaaaaaaaggaaaaaaacaaaaaactatcaggatttcatgcatttcttctcccatttttcctgtcccttctttccctgagttatgctttgtctcttctctttccctagtgtgagccatagatattcaattagactagtgttttttctgttaattacaccaagacttttgaactcagccagaaatgagggttgaatcagatagtcccaagtaactggtatgtggtgtatccttaaaggtggatttaaggatagaatcaagagaaaaccttattggagcttccctgatggtccaatggttaagactccgtgctcccaatacagggggcatgggtttgatccctggccagggaactgggaaactaagctgccctccctctgaccacacacacacacaagaatagaaccttattctgaattttgcttcctaccatgcccttagaacatatttggtgaggatggccctcccaagccccctaggcaggacaaaggtggtctgtgggtgggcttctttccctttgtccctccagattcactctccatcctgatgtggtcatgtatggatgtgagaattggactgtgaagacagctgagcgccgaagaattgatgcttttgaactgtggtgttggagaagactcttgagagtccctcggactgcaaggagatccaaccagtccatcctaaaggagattagtcctgggtgttcattggaaggactgatactgaagctgaaactctaatactttggccacctgatgggaagaactgattcactggaaaagaccctgatgctgggaaagattgaaggcaggaggagaaggtaacgacagaggatgagatggttggatgacatcaccgactcaatggacatgagtctgagtaaactctgggagttcgtgatggacatggaagcctggcatgctgcagtccatggggtctcaaagagttggacacggctgagtgattgaactgaactgaactgaataggaacttaaagtctgaatcaaagagattatcctttgaactccaaggttactacccacttacttgtaccagagatactgagcttgaaaatagtagtcctgggaagccaggcctgcctccacaaaagaagcagaggagggaaggcaattcattctatgggtgaaataaaaacctagaatattcaaagcattttcttctacttggaggctaacgaacatgggcacagtctgctaacatattttcatgcatattgtatcatgacccccataacaacccaattcacttaatccacgaagaattagactcagggaaggcaagtataaccttccagtttcctacacaattatacctccaggaagggcagttcagctcaaggcttttgactccaaagcttttgccttaatgctagtgcccagaggcaataaaattggaagtaaattttttttggtaaatagttaatctgaccatgcaaagtgggcagtgacctagaacacactcaaagagttctaagagcagaccagggccttgggggtaactttcttcccagacatgctgctaggctgtccataatgcaggtccattccccaccaggctttcctgtcctaatctgtggtgctttaaggtcagaggctggcttcggggcagctgaggaaggctaaccacccacaagagaggctcccagatccagacagcagaggcacttccacgcttttaagcatcactgctgctgcccacaccgcctctccagcctgtccttgcagtgctagtctgagtgatctggggccctctccagggtactggttagagcaataacaatccacaaaagaaaagcgcaaccccggctttctccacttccaggaaattaggcagacaaactaaaccccagcaaaaggggaagtgcctctactgacagcatctgcatcacccaggagcttgttaagcaaattctcaggcccatcctcacctattgattgggaatctgtgaaggtggtgtgaacaaagaatgttgcctgtcagtatcaggaaacaaaggatattttgaccatcaagccatcaatggcctccctgatttcaatgagactactgaaaaagcactaaattcattaacttgagatgtctgcgcgtgagctaaatcgcttcagtcgtgtcagactccttggcatcctatgggctgtaagccgctaggctcttctgtccatgggattctctaggcaagaatactggagtgtgttgccatgccctcctccaggggatctcccccgcccagggattgaatctgtgtctcttacatctactgcactggcaagcaggttctttaccactacagccacctgagaagccatggttttgtttacttaacgctaaatgtgaagggctgtagcctctcgggagggaaggaggccttcgaagggagggctatgccccagctcctccatctctgggtggggtatgggtggcatagtctttagaaattcagttcagttgctcagtcgtgtccgactctttgcaaccccatggactgtagcccaccaggctcctctctccagggaattctccaggcctgtcaggcctccctgtccaccaccaactcctgaagtttactcaaactcatgtccactgagtcggtgatgccatccaaccaactcatcctctgtcctccccttctctgaaggggaagcgccaaagaattgatacttttgaactgtggtgttggagaagactcttgagaatcccttggactgcaagaagatccaaccagtccatcataaaagaactcagtcctgaatattcatttgaaggactgatgttgaagctgaaactccaatcctttggccacctaatgcaaagagctgactcatttgaaaagaccctgatgctgggaaagattgaaggcgggaggagaaggtcgctctaaggggtttgtaatttagtttggtgggcatgcttctgctgctgctgctgctaagtcgcttcagtcgtgtccgactctgtgcgaccccatatacagaagcccaccaggccccgccgtccctgggattctccaggcaagaacactggagtgggttgccatttcctcctccaatgcatgcaagtgaaaagtgaaagtgaagtcgctcagtcgtgtccgactcttagcgaccccatggactgcagccctaccaggctcctccgtccatgggattttccaggcaagagtactggagtggggtccattgccttcgcccctaccctcctttgtaagaggctgaactctcctccccaggtagtcatgcgagcaaatgtcctacagcctttcaatttcttgaaggtggaaactcaacccaggtgcctggacactacagctagtccctgcctccactgcgagcatgcgcgctatcaggctgccctgagaccccgcctccctcaggccccgcccctctttccctgcctccctcaggccacgcccttcgggtcctccactgcctcgccccgccccgcgcacgcgcaggggcgggtttttttcctcccgtgatgctccgtggcgcgggcgatttgtagctaatggcgggcgcttggtcctcggattgttgtgaaggatgttcctctactaactgtacgtgtggccacaagagcaagtggggtgactcctccctgttaggcaggcggctctcggaagactcgagccgccaccagctgctgcagaagtgggcgagcatgtggagctccgtgagcggagacgcatcggcggcctgccctgaaaggaagcggcgcgaggaggctgcggagccggcggaggaggacaggccgctggtttttctgtgctcgagctgccggcggccgctgggagactcgctgagctgggtggcgagtcaggaagacaccaactgcatcttgctacgctgtcagttcgggctgggtcgcgtagggtgggatttaggactaagggttgccttcatccctggtgtgcggcacctgggcggcctcggaagaggcgggggtgttttggagcaactcagggtctttaaaattagcagaaaaatctgagaggctgagtttttccagaaaaggggcaggaggagagtcatccctgcatcttgggcttacgcgtggaagtccttttctggggtccctcatcccagaagagcaatggatgaatcaacaacgtcgtgagcatgacttaggggacaaaaaagtcaaccaaccaggttgtaagcatttaaggtgtagctactctgtgttattccttatagaaattagtgggctctgttggtagtattgttaattgtttatttaggaaattaagcttttcagcggcctgcttcctgcaggggatgtcaggattgattttccagatcctaatatttgtatcagcggacgcctttagtttgaagtgttacaacttcagagttgacgaatcataatgctattataaaaattgaaggagacttgcaataaaagcactaacagccctcacaaaattggagaggaaggagaatgtggtaaaagggtgaagaaggtcagagttctaacttttaatactgattctaccagttacctgtatgtttccccagagtttctttgttttgttgttttcatagtacttatttagggaagtggttcactgagttaccactaagttttctgaattagtaagttttctgagttacgtggttttctgagttaatgtaaaaatgactgttctttttggacttgcagttttcaagattaaatttctgttatatttgaattctgtaaatatttttaatggcagaaattcaccaccaatttattgacatttgtgaaaagttttccttcctgggatgtattgggaagaaagaaggaaagcagtgtccacctgttacctgaaactttttgaagtctgttttccttaaggatgcacttaacaataattgctgaatcctctttggttgttaaacataagcctaagaacatacatttcccatagtaattcattgagattaatccttcacacctattaaaatcaaacaatgcagaagggtataaaagtaaaaaggacttgtccccaaatcttatcccctgatcctgacactctcaaggccccagagttcaacatgctttattttcattcatacttccagatactctccatgcatatatgagcatgtttaaacgtacattttttggaattccctaaacatataaattttcaaaaacacccttgggataatgtttatactgttaagcatccttacctttttattctacatctatattctgagtatttttccatattagtgcatataggcataattcacagttttagcagctgcctcttgtacccctgcctcttgtacctcaccagtataggtgatggccctcaactgcatgggtttgaatcctggtcttccacttaactagctgtgtcttggggcaagctacatagcctctctgtgcttcagttttctcctctatagacttgaggataatacatgcggtaattaggaggactaagtgagttagtgtgtgtcctgtgctaagaagaaataggaagtgccacttaagtgacatccttaatggagatgctgttcatcctcccagtctgcccctgttgatagaagtctaggttttttcccagggttgctgctttagaaccacatgtatgtatttgggttgagattttgctacagtacgagggcctttgtaggctgttataattgagaatcttaatctttattctaaaagtgaaaatgagagtctattctagtgaatgtggtgtttaagctggagagtggtaggactcaggtttttctttggagatgcactgaggaggagaataagcatggaagtggggaggtcggtcaggggccagtacagctgctcagggagaggaggtagcggtggtgtgaggctggagtgagggtcatgaggtagagcggacaggacttctcagaggagtgtctgaaggggagcagggaaaggagatgatgaatgtagggtgacaccaatttctgatctgatgggcaggtgggagtggagtttactgagttaagctagactgtagaggaggtgaactcgagtctgttctgatgtcctttcttcatgtccctccaccttctgtgtgtcctgaatttgggtgttctgggaatgtttcctgttgcttctagggttcagctgtgacccctgttcaagttgtggtctaaaagatttggggctgggttcctgtggaccctctgctgcttacaggaaaatgagctctgtgtttgagacttggagatgtatgcacagacttttaccctcttctttgggttaatccctgttttactgtgtttggcaggtatacttgatagtctgtgatttgaggttctgattgttccaagtttcaccgtcaactgaattttttcttctctgatctaagttttaccatcaattgaatttttttttcctaattttattcattttgttaacttcagtgttttctgggaaaggaaggaaataactcttattctgctatgtttttccagaagaccctgtacacttagttttaaaccagtgtgtgcgtgtgtgtgtgtgtgtgtgtgtgtgtgagtgagagagagagtgagtgagtgactgactgacttttgggcctttgttttttttctggctttttgagttctaaaattaaagttgaattagaagttctctaaatacctgcatatcaaaccacattaatacattgttgttacttctttccaggtgttacctgtaatgtttctgtgaatgaggaacagatattatccaaacgtaaaaatgaaaatggttggtgagtaaagctatatctatatgagtatgtatgtttttatttttttaaataaaaatctttaaaaagatcatcagcactaaaatttgggataaaacttttttcatggtgtgtgtgtgtgtgtgcttagtcgctcagtcgtgtctgactctttgcaacctcaaggactatagccttccaggcttctctgggggaggattccatgaggattctccaggcaacacaactggagtgggttgccttgcccttcttcagaggatcttcccaagccatgaatcgaacccaggtttcctgcatttcaggtggattctttacagtcagagccaccagggaagccctttttcatggtaataccaaatcagtcattgtgcatgcttagtcacttcagtcgtatctgactctttgcagtcctgtggtctgtagcctgctaggctcctctgtccatgggattctccaggcaagaatactgctgtgggttactgtgtcctcctccaggggatcttcctgacccagggatcgagcccaggtctcttacatctcttgcattggcaggtggtttcctgagtgacagtgggtacctttagatttaagatggaagagtttctaaaagtctcaaggtctgttccaacacttccattttgggtgtttggcttggacctgaaggacattgaaaataaaaacagaaaaagaaagtatctttatcatggaatctctgagccaaagaatgctttagataaatgctccctacttttcatgccgtagcacccatagataatgctgatgtggcacatgtagacatgtggcccattgaggtaaacagacaaggctgcatgcatggcggcataggggctccagctgtcccaggccctgttttatctctccaggtgttgaaggagtcagtatcctgctctacctgccactgtctattgcaagcagcatcctcagcaaactgaatgggaagctctgctttgtagaatcgttgtccaaaagttgtcttactgatgcatatgaataagtggtacacaagcaattcgacagaaattactaatcatatattaaaattttattattttttgtttattttaatatttatctatttggctacacagggtcttcatggcggcacttgggatctttgatctttggttgtggactcttaagtgtgcaaactcttagttgtggcacatgggatctagttccctgatccccaaggatcaaacttgggccccctgcattggggagctcagtctcagctgctggacaccagggaagtccctattttttttttcattttaaaacattggtttttcatttttggtaatgttagagtgtcctattcaaatagagtatattttcatttaaaaaattactctctttaaggagaatttaaagtcataatatgacaggtggcatgcaaatgtaacagaaattgtactgctggcatgcttgtggtaacaatttggaaaacccagccttggatcatttctcactttattgatgaagagacagaggcctggggaggtttacagcctcaccaaggacataggccgttagaggagctaatgatggtgctttgctgtccctttgcttcctgcagagtgtcctctgcttcccatttccagtcattctgatgtcagcttacagctttgctgtcgcgtactggatatttttcattacattgactctgagtttttaagttcattttaaaaggaatctgtatgactgctgtgaatgtatcaattgctgttgctcgaaagtaactgtgacgataattacagtggaaacaaatgttattaaattctagctgagatacctgctggctggctggttctgagcctgaggtctgtcctcttacagttaaaagatttgcagctgtgagatacacattgaagaccttctagcaccaggctggctgttgaggtcctttaatggcctggaacttggtgatccggagtcgatgataagaaagtaaaggagagaaagaggctgatattccttggtttacacagaaagccaataaagcccctgcacggggcttgctctgttcacgaaggcctcaggtgccctctcgatggggtgaaggcacagagcgccttctcgagagggtcttagaagcccgagcaggaaagtgaactcagagagtctctgcgttccaggggatcagcctgaaaaagagagagagaaaaagaaagacagacacggggaccagagctctgatggagcaaaggtgttttaatcaacttggtttgggcatatataccgtcttacaaagtagttattctcagcaaagataaagattaaaattccagacttacaaaacataggcaatccatattaaagagagagatttgtaaacaatcacttttatcgtatggttctcaagaaggaagagggtacttatcgccatatagaaacgctaatgaaggaaatgcctggattcctcagtcccggagaggcgtgcctctcctcttaattcctcttaattcctgaatattcaggaattaataaggagcagagaattcctgtcagatccaaaacagcacataggaagcctcctgttaaatgcttcctgacagctggctatttcaaatcctgaaagatgatgctgtgattgcactcatctcacatgctagtaaagtaatgctcaaaattctccaagccaggcttcagcagtacgtgaaccgtgaacttcagatgttcaagctggatttagaaaaggcagaagaatcagagatcaaattgccaacatctgctggatcattgaaaaagcaagagagttccagaaaaacatctatttctgctttattgactatgccaaagccttggactgtgtggatcacaataaactgtggaaaattctgaaagagatgggaataccagaccacctgacctgcctcttgagaaacctgtatgcaggtcaggaagcaacagttagaactggacatggaacaacagactggttccaaataggaaaaggagtatgtcaaggctgtatgttgtcaccctgcttatttaacttatatgcagagtacatcatgagaaacgctggactggaagaaacacaagctggaatcaagattgccgggagaaatatcaataacctcagatatgcagatgacaccacccttatggcagaaagtgaagaggaactaaaaagcctcttgatgaaggtgaaagaggagagtgaaaaagttggcttaaaactcaacattcagaaaacaaagatcgtggcatctggtcccatcactttatggaaaatcaatggggaaacagtggaaacagtgtcagactttatttttttgggctccaaaatcactgcagatggtgactgcagccatgaaattaaaagacgcttattctttggaagaaaagttatgaccaacctagatagcatattgaaaagcagagacattactttgccaacaaaggtccgtctagtcaaggctatggtttttccagtggtcatgtatggatgtgagagttggactgtgaagaaagctgaatgccgaagaattgatgcctttgaactgtggtgttggagaagactcttgagagtcccttggactgcaaggagatccaaccagtccattctgaaggagatcagccctggtatttctttggaaggactgatgctgaagctgaaactccagtactttggccacctcatgcgaagagttgactcattggaaaagactctgatgctgggagggactgggggcaggaggagaaggggatgacagaggatgcgatggctggatggcatcactgactcgatggacgtgagtctgagtgaactccaggagttggtgatggacagggaggcctggcgtgctgggattcatggggtcacaaagagttggacacgactcagcaactggactgaactgaactgaacttagcaccaggctgagacttttctgttcttcataatcaagatttctagagaactgaaaagggaatcaactcttgctctgaaccagtttggctgagttctgctctctcgtatcacctgaaccccatcctttatgccaaactgtagctcatgggcgaagcacctgtttttgtaaatatgtttttattggaacacagctcattcagttatgtattatctgtggtggcttccatgctacagtggtagagacaagtagttgcagtagactccatgtggcctgcaagcctaaaatatttgttctctgactcatcacagaaaaaaatttgcctatccctgccccagagcattaatgatccttggtggacaatgtgacatttaaagaacatgtataatcttttccctttatttcagaattttagttaatttttaataccagattgagacgtttacattctagaaaagcaccttcttcttagtatattctcttcttcttttttgtttttctaaatttttgtttatttttgtctgtgctctgtcttcattgctgtgcatgggctttgtctagttccggctagcagggagtgctctctagctggcggtgtttgggctctcattgcagtggcgtgttgtggagcatgggccctaggagcttgggcttcagtagttgtgcacaggcttagttgctccatggcatgtggaatcttcctgggctagggattgaacccttgtcccctgcattggcaggtggattcttatccattgtaccaccaaggaaatccagcatactctctgctttgtcacttgtgtgcatgccgtctgtcactagatactgaaggcagtgtgacctggaggtgacttggatacctttcagatgtaagcatcttactatctttttttttgttcctttttatacataggacctagtagggtcaggataacatactttagcaacttaaacgtttaggtgtttatggatctcaacaatgggatttttgtggtaaccagttactaaagggtggcgtttttggttgcagcatcctggagactttgtactgcacaggatgttcgctcaacctcggctacctgtacaggtgcacacccaaggatctagactacaagagggacttgttctgccttagtgttggagccattgaaaggtatgtttgaggcaaaaatgaacagctcataactgaattctcagaaagttgtttgcagacaaattggtatgaaaacttggagactaaacatggtttggttaaaatatgtttttaaataataatttctgaccctaaagcaagtgatttttgttgttctttggacctgatttatttgctattggaaaagtcagtcatattaaattgtagaagaaagcactgtgagaacattttgcagagtaaaaatttgctatttttcttaattaaatttagtttaataggattttttaaaaaagcaattttgtgtatcaatatattttgtccattttatttttccctctagtttttagtctagtagaataactggaagaaataggaatttcagaaatggttgggaaagaagtccctttggtgttctggaaaagtagaaatgcaaagtccagttatttcctagaggattgtaaataactgtctgctgttttgagagatgcaaggaagtaccttcatttttcaagacttctaaaaggtgtttggagacaaggtgaattagggtctgatgacgtatatgttaatgaccctttagttcattaaccttttaaaattggaaacaaaattaattgaccccaatgtcttttcacttatcctggaaaagatgtaactctcaagactttagagattgttgttgcttagtagctcagttgtgtccgactctttgttaccccatagactgtagccccccaggctcttttaagagtccatgggattctccaagtaagaatactggagtgggttgccatttccttctccagaggatcttcctgacccaggtatcaaacttgtatctcctgcattggtgggcagtaacgctgagccaccagttaagagaggttttcttagagatccctaggaaaccttaaatatcaagaaagaagaacaatttaagaagaaaagaaagtgcctacactttcattacttgaagtatgttgtcactctgttgaatttcttagattttctctttaaaaaaatttagaatagtatttttattataatttttcatttaattattttttgattactacagttttaccaccatctttgaaactaaacaagtttggatctaaattgtgaactctgcaaactttttacagcctttaacacaagagaataatgtagcaaatactgctcattgatgtaaagcgtgcaggcccacctggagagagatcagatctgttttagttttaatatgtaaacagaagacgcatgcccaaacaactgctcccttaatgtccatgggaattttaccaagatttgtgaaaattatgtgggggagagtacaagtataaactacatgaaatcttaaaccagtgtggttggtatggaactttaaaagtgatccatatctgtataaaagaaaatatgtggaagatttctgcatagaggatcctagtatcgaagctgttctttccccaacaattgaatttaaggaaaagttacctcatagggcagaatttaaatgacagggaaccaggggtgttttagaaatggatgatctctgtaatgtttatttacagcattataaattaatcagtgccatttaattttcccccatctcatttttcttttccaaataagatattaactgccttctgtaatttttccttcgatgacattttttagaaatttaatcaattaatcttgggtttccagcagaagactgtttacatttaacagaagtgacatactgaagttgttacatgtggtgaaagacttctaaagaaatgcaaacaaatgaaggttttttgagttttcttttgggaataacagcatcttctctactgtttagatttatttggttgccagatttatttgttttcttccattgctaggccagttgtcagagaaggcaatggcaccccactccagtactctcgcctggaaaatcccatggacagaggagcctagtaggctgcagtccatgaggtcgctaagagttggacacgactgagcgacttcactttcacttttcactttcatgcattggagaaggaaatggcaacccactccagtgttcttgcctagagaatcccagggacagaggagcctggtaggaggccttctatggggtcgcacagagtcggacatgactgaagcgacttagcagcagcagcaggccagttgtattttcaaattgtagcatgtcatcacctcagagagcgaagcaaagcatgagttatagaatgcaaaacatgagttatagaataactgttgaagttgccgaaatctaggtaatcaacaattgacgctacagattacataataaaagtcaaaacttgaaaatgcacatgttcttgaaaagttatataaaacagtggcttcttcaggatcttttaaaacttcaaaatgttactgttgtaccacccagcttactaaagagccagttttattccctataacgaaatatttatagcattgagaaacatgtagagctcttggacaaagctgttatggagaaaaacatgatttcatgtagttcagcttcctatgtaggttgctattaacaaaagtaattgttttatgtgtttacttggtactaatatatacttcaatatactttgagttttaatgttaccaatataaacttcatatttactcccttctcatattttaactttgtattgtactgtacttcagttatgttttagggtcatctgaaaggcaaattgtgtcagaagacaaagagctttttaatcttgaaagtagagttgaaatagaaaaatctctaaagcaggtaattttgttctgcactttttgtgtctttgtataaacaacttccagtcaatgaccaagtgctgctccacgaataattcttaattgtgtcttctcttttgatcttagcattcatggtgagagagtgcttattttatttcagttgttagtaaagttgatttactggaagctacttttcactttcctgcattggagaaggaaatggcaacccactccagtgttcttgcctggagaatcccagggacggggaagcctggtgggctgccgtctctggggtcgcacagagtcggacacgactgaagcgacttagcagcagcagcagcagcagcaaactacaaattaagccaaaactttatggaaaaaattataaagacattccatgctaaatcaaagcagtatgtattctaaaactattaaaatagaaatatatctttaaatcagtatttgatttgatttgattttcgtggtaaaaacagccttgtttttgaatgctaacatcctgtcacaggcaagatagtggtgaataaatgtaaaagctatgtatcagaggttgagaactactattaataggcttatgtcttatttaaacagaattccattaaataaacacagatatgtataatgtataacatagcagaaattataataatgatcaacatttaaatcatatttaaccatgtatgattttaatcatatgtatttttttctattcttttttccattcaatagatggaagatgttttgaaagccttgcaaacaaagctttgggaggtcgaatcaaaactgtcctttaccagttgtaaaagctgaattggttccaaggcccacattctgcagtcctctgctgatggagagttatttcatatgtagcaattcttattataatatccttcacttagaactgaaagaattggaaacggtcatgtacattgtatcctcttgtactgatcagctggtcacatgagaagaactgtagaacttttctggctgtatttgatggtaaagaggtgattgtttcctaaactccagttttaaagtcatgattattgctggaatttaagagttgttgttttggtaacaaactgctataattttttgaatagttttctcctctgtactggatttgctattttttatgtcctattaactatgtttcacttctaatagtttgagcactgtttagtattgagtgcttgaaaatcttagaggtttttccatccactgtgtggttgaatcttctttgaaaactaatgaatacagctttctggagaaactggtcagttgaattatttgtcaaaactctgaaatcttgcacaagagtagattagcatgtattatgttggttggattccttttggtcctgtttatttactcttctgtgcttgcttagccgctcagtcttgtcggacttttcagccccgtggactgtagccctccaggctactctgtccatggggttttacaggcaagattgctggagtggggtgccgtttccttttctaggaatcgaacctgtgtctcctacgttgcagggggatgctttacctgctgagccatcagggaagcccttatttactaccatatgccccataatctggcagcatagttaccaaagagagtagtaatcattcccaaggttgggattctgggagaattttcagttttcataatgtaagacttctagtaagcacttgttatttttataatgaggggaaaaataaagattaaaacaaagtgctttacaattgatttttatgaaacagttgtttaagtgagcgcaaaaatcctgctgtcataaataccacacatttactgggcatggcagtgtgaggggtcctgctcaggactctaaaggtaaccccaaatttccccagcctccactctgtttttgagtataaatgaggccacctaacattagtactcagcatgtttgagtaacttaactcaatttctgcccagaacctccctaattatttccgagaatacctcaagttgtcatggcaaaaggtcctaactcaaattgacttgatcattgatcattcacaattactacgttctttttgaaagattgtctgcagcctctaatcatttgaagttagtgagctgtccaggtctcttctcaacacctgctggcaacagtcaccctgcctcagtaagcttgatgaggtccccagggtctgtcattgtaggtgtttcggtggcgcttgcgtgaaagttcatttggaacagatgggagagttattttaaccgagagattcagctgactttctagtcgcacgagtgaacagtattctccagtcactttcagggccattccagtttcgctccttaattccttttaccctgttcatcctgggctccaatttcaagccaatccatacaccttgaaaacaactcatttcaccaatgcaaagtaatttctaatatccagcagtgctaaccaagcctctcttgtggttcaggaaataaacagcccaagtgcctttgtggcagtttgggcctttgattattatttccctgtacactctccacgcttggagttttatttccagtgagggttcttcagacgaagttagcttaaaccatgcgggtggagagctcacacacatttatcacacagtctttgttgaagcatctgaaagcaaatcccaggaaacagtcgtgtctccgtgtaaagcacagtctgtgtctttggcctctgtgatgtcgcttaaagagtgggcttactatcaccgtggggaagagagctttgagacgcccacgctgcctactcgacaggtccacgtggggcagtttcatcctccgcaggctgccctgtggcactctggaggagagggcctgttctcacactctgtttgggtcagcctctgctgaaaacaaccacccgtttctctgaagcctagtgacttcaggcttagtgactttttaggctttgcctgatggctcatgggcctgctgtttgtttgtttgtttgacttgccctatgtagccacatattaaaatcaacaatcaggcctggttcctactccttgtggctgtgtgctgctgttgctggttaccactgcccatgagcaggagtgaggatcctggagcaagaaacggacattccagcctgaattgcacaggaccccaacaaagaggcttcaggtaggatctaaccagaatttgtttcttcagccaatcctcgtgaaagggtgctccccagttcttcagggagaacctctggaaactagtatcaggacctatttacagattgttgtgaatgcatgtgtatagaacattgtacatggttttcatcccagaatgtgggttctgctgttctcagcaagctctcctgttatgttcacaagtttccaatcttacgagagtgcgatgggtattgcttgtgtaggatcgatgtctaggcggagtatgtcctatgtgggtgattctagtcaggcttcgggcattaaaaatgggcaaaatgagagtgcctccgtgcagagttgggtctaggtgttcagtaggaactacttgagaggagccatgatgagcaacatgagcttttgagagaatcttggggatattaacccccggccagagtccccagcttcaactgctctattagccttgtgaccttgggcaaatcttttacccattttgagcctgtgttttcttatctgtagaatgagctatgataacctgcttttgcatcacagataaattagtgcttatgatggtactttgaaaacagtaaagcatcacaaaaataaacgacaaaggtgtagccttgtttaatttgatctgattcagtcttcttgtcagtctgacttctagtcagattgtttggatgtcctggcacctcagaggcaaagaatctgcctgcaatgcaggagatccgagtttgacccctaggtcgggacgatcccctggagaagggaatgtccacctactccagtattcttgcctggagaattccaaggacagaggagcctggtgggctacagcccatgggatcggaaagagttagacacaactgagcaactaattcaaaagaaaaaatctgaaacaccatatttaaaataaacacagtgacactggattaagttcatcctctgattacaaatacatgaacactgtagaaaatttgaaaaataaaacagcacaaagaacaaaacccacacacaatttcacaactactttttggagttttattcctgttgtcattttatatacaaatttagaattgttctggacatactgtttttactaaaaatatttcataaacatttctgcatcattaaacgttcttttgtaacccgatttttaatgactacttaggatgaagcatctgttttcaagcttgtttaaatgcgatcctttggtatgaaattcgtactttttagtggcttaacaacttagtttacttgtcagataggagagaaggcatgaaagaagtctttaaccagccgcctttttgtctaactgcagggtgcacaggagcagccagccaatggttaaaatttcaggaatttgtgaactggctgttcaattcttggtaacttcaaattggccaggattaggagcacagacacaagcaagaggaacattccaagtattgggaatgagcaggaccaaatgtgacaagatccctaaaatttagcctttgagaattagcgatgaaatcaaaacacacaccatcgtgggatctttgcctccaagatcctgacttcctagtcttcttgactgaggtctgcactgccagagaaaagcagggccttgatggtgtggacagcgaacccagataaattcaggcccctggcaggttctgattccatgtaccgaggtagcgctagttgtaaagagccctcctgccaatggaagagatgttagagaggtgggttcagcccctgggtggggaagatcccctggagaaggaaatggccacccactccagtattctttcctggagaagcccacggagagaggagcctggcaggccacagtccatggggtcacaaagagtcagacagtactgaagtgacttaacatgcatgtaggagtatttatggagaaggcaatggcaagccactccagtactcttgcctggaaaatcccatggatggaggagcctggtaggctgcagtccatggggtccctatgagtcggacgcggctgagcgacttcactttcacttttcactttcacgcaatggagaaggaaatggcaacccactccagtgttcttgcttggagaatcccagggacgggggagcctggtgggctgccgtctatggggttgcacagagtcggacacaactgatgcgacttagcagcagcagcaggagtatttataccagagaaatctgcagttgctaaaaggcaggattacttccagagagctgctttcccggaatattactgtgtattttgaacctccctctctactgtttgacttaaagtttgagaagagaaattgacttctgtattcaacactcaaaagaccaagtcctgagatctttttgtctaataaatatcaaatgaaacactatcttttggactttagtgattggactgtcaaggtcttcacctcttttgaggaaaaaagcaaaataccttaagcgacaagattatatataaatagtgactgttagacacatctgtgtttgttcctgaattaagataaataactggacagttgcttgcctctgaacaagcagagaaagttcatctgcaatcactattgaactgagagacaacatttactctttagcccagacatgttctggatatagcgatggttaattttgtttagtgagagctaagttccgtgtataggatgttttattatccaggcctttgttcacgatggtgcaagtgcagccaaggccaatctacataactgtagtctctctggagtgtttacacttgtctaaaatgttattactaatctgggaggcagcatgaagtgaggggatctgaggaagtgatgtactggagtctggagttttattggcccaaatgtggtttcgaagagaactggtctcatttcattcagaattagctcctactgacctctgtgagcttgacagaattaaattaactctataacttttcccccctaaacaattactaccatggtttctagatcctctatttaattttatggcagagagatggacaaaggaatctctcaagggtcttttgaaccttataactcgtgtaagctgaaaggaaatcagaaataaaggagggaaatgagaatccaggagccaacttggaagacttgaggataatttagttctctttttaacactttcaccttcctgtctcaggagctgcaagcttgtaattttgaagacttgagaatcatagaagttgcggaaaagtaaatggggttccctggtggctcagcagtaaagaacccacctgccaatgcaggagatgagggtttgatccctgggtcaggaagatccatctgctggagaagggcatggcaacccactccagtattcttgcctggagaatcccatggacagaggagcctggtgggctacggttcatggggttgcaaatagacatgactgagcgactgaacaactacaagatgtgtgtttgattgaataacattttccaaagcaaatgcaagagtgttataattttgaagagaaatcttatgaagccatcaaacggtattacctgaaggggacagatggcttacttttgacgggcacatcggcctcgccggggctgggtaacctttttgtccttagcgaagagcagtcatttactgtgtaatcatttgctgtgctcggagctccacctagcttgtctcactccatcagaaaacctctcatggaaagccttcttccccttttatagatgcagaagctgagactcacggaagttaaatggattcacctgctcagctgatgaatggagccaagggttttccttctgcgcactgctcctcctctctacactgagtgcatttcggggggtgcttccttgcttcttagcagaaaaacacgtggaaggaagctgtggtactaaaagtcctagtgtccagagatgttgaggaatcatgagcttctccagacttgcctggtggtccagtgattaggactctgcacttccaatgcaggggacacgggtttgatccctggctgcggaactagatctcacatgctgctcagtgcagccaaataaatacgtttttaaaaagtcatgagctccccactcccagttttttttttctataattaaagcagattgagcccccttgacatgagttcccttccctttcttcatccctgctttgagatcctctggctgccatatctcccggcctcttccctcctcagcccagagctgctggctggcctgtttcaagctctcagctctccaggtaattgagtctcccttgcaaccacctcccgtgtgccattgatgctactttactgcacttcccacaatgaacatattttacccttgtgtgtttaatggctgtctctccattggagtgttagctccacgagggcagcagttttatccgtctttcaccttgtgctgcagaaatgcaggctcatggtaaatgctcatttaacacatcagtggagtgaatgaatgctgctgcatcacgtagctatttccccacatcgttagcctttgttcaccctctcgagcatgcttaggtctcttcttggtgacagtcgtccctggacttgacctacctggaactgtatccactccacctgctgtggtcttgcactctgggcattactgaatccgctcttcttgaaggccaccgaggagttccaatgaagtgtcactgtctgtctgaaacccctaaggcttccaataatttaaaactgccctcccctttaaagttctcttttcagttgatgaaagaggcaggggcgcgatgccatgaggggtttgctgtaaaatatttcagtaaggtaactatacagcaagagggcatgtgggcatagcttgatcactgatcacctttgaatggtgattagtgtgtgtgtgagtcgctcagtcgagaccaacactttgtgactctctgggctgtagcccaccaggctcctctgtccatgggattctccaggcaaggagacgagtgggttgccatgccctcctccaggggatcttcccaactgagggactgaatctgggtcttccgcattgcaggcagattctttaccagctgagccaccagggaatatgtgcattggggggggggtgtgtgtatgtgtgtatttttttttgtcagaccaaaaaccagacccacatccttaatggcatctgacctgctgcccttcctgacggttctccttcctcctgcctcccctccttctacccatgaccttgtttctgtctcctgcctctcctggatgcttcccggcctgccgtgacttcagtgaccagtgctgggtctctgactcccgcagccctaagccgtctccccagacccacccagttctgaattcccgaccacctgcagccctatggctcccgtttatgtataggtgcatgccgagtgtctctaatgaatgcggatggtttcctctcaaggcccccctgcatacccctgtcccctgcctgtgcctcctgagttctcagtgacattgtccttcttgtgtcttggccgcgaaacgccagaggcccgtgacctcttcaccattctttgcttcgcctccaatcaattgtcaggtcccctgtcttccttgcacccactccagttttcttgcctggagaatcccagggacagggtagcctggtgggctgctgtctgtggggtcacacagagtcggacatgactgaagcaacttagcagcagcagcagctgtcttccttcccaaagcttcttttctcttccctgcccatttcttccttgctatttatccttgttcaggcttccttgtttcttgcccgagttattgcttagttggtcttcctactttaattcttacccctcgatctaatgaacacaccattgtcaaatgaatcttctgttcagcatttcccccaaacacaagcggaacacagctctcttaatctgagactccacgccccctgatctggccccagatgacttctcagctctagttcccacatttcctacccaggactctgagcttttgtcaacactctgtctcaccccaggccttttctatatatacagttcttactatctttcaaggtcctgctcaaatgccacttcttccaggaagaccttgctgatttctcagccagaggtaactgcttccacttcatcattcctaaattacttcaggatgttcttgcctcatttcatgtaataatttttgtaggaacttttcctgcaaaactagagttccccccaccccccgccaaagacccaacatgttgtgagaccttatatgctggaggtaattaatacttgtcaaataaggtgagaattttaatctgtcattttaatcttgtctgctgctgctgctgctaagtcgcttcagtcatgtccgactctgtgcaaccccagagacagcagcccaccaggctcccccgtccctgggattctccaagcaagaacactggagtgggttgccatttccttctccaatgcatgaaagtgaaaaagtgaaagtgaagtcgctcagttgtgtccgactcttagcgaccccatggactgcagcctaccaggcttgtccacctactttgtataattacgatgataaatggaaaagtgtgaaaaacgtctaagctagagaaaaatttatacccaagcattctaaattgcttttaatatttcagaattgacatataagactaaaaagaaactatcccaaaatgcagtggtcgggtagggttagaattcaatgttaaccaatgtaaataggaattcaagggagaattaccaaactgaacttatttacatgtataattacccacctgtgatcattctaccgtcttatgtattccattttccccctcctacatcaagttaaaaatacttcacatcttttttttctttctaaccaaatacaatgaattcttggaattgggagtgggatgtgaatgcaactctaccacttgaagcaagatgcaaatgggccacacgtgtgcagttggtgtggtggggaagccgagcagataaacttataagccatgctcaaatatgcaagaggatgtgtggaaacagcatcggaaacatcttgctgcttccagccatcgggaaaagccatgaaagaaaaccgcaactcttattataatgtggaaatccatgaagcacaggcctatggcaacctgagattgctgcttcctttgacaagaaggtatttgatagtaggaacgtgtcggtggctttgccttcttaagaagcgaggaggaaaggatctctcggagcttgaggagagaggctcttgagcttgaagaagcaaaaggaaagtgttccttagtgtttggagggggaaggaaccgtaacccctggggttgctctccagggtgcctgtgggccctgcagtgcaggactctgatggaacctccctggctcacccagagggcaggggccttcccatgagatcctggcactcacagcgtgggcattagctcctagatcctgccaggtctgctctgaatttaacaaggccttggtgatctgctcgcaggtttacattggagctgtgctgcttagaggacggggttagtgaacacctgtttcatgcactcgtctgtttgatcacgatcagggtcatcattaatgacccggaacaccaccttcgtgttctcagcatctcctttaacacttgtaaagtgggtaggttagtagtactcctctcctgcttttgagttggatttttcttaatcagaccacaaggggacgcatttcaccgtgtaaatactccccgcatccagcccagtcacaaccacagagtcaagaggagctgcagccaaagccccctcccacataggctgctccatctcaacttggagtctcccctctccgtgcttgtaaccaagctctttaattaaaataagatcaaggtctctccccgccagcccccgcccccgaccagtgccaagggcttgggttagtcagcattcattctgaaatcctctacacctacccgcccacaagccttccccaagagatttacatttttacagggggaagttaattatgttttctcttgcagtcatttctgatgtttccatgactcaggttcattactaagtcccttcccccagtccttaagtctgcgcttgcgagctccctttaaacttgccaagaggggcgtcagcctcccccgaggaagcacgtttcccatcacctggcttgagtgtctgactcacagggcttccccggaatccttgcctggatcactgccgcttattccttgggaaatactcaggaacactgttatactcactggtggctcagacggtaaagcttccccctggcagtgcaggaaatgcggatttgatccctggggttgggaagatccttcggaggaggaaacggaaaccactccagtattcttgcctgggaaatcccatggacagaggagcctggtgggccacagtccattgggtagaaaagagtcggacttgacttagcgacttggcatcaccgactcaatggacgtgagtttgagtaaactctgggagtttgtgatggacagggaggcctggtgtgctgcagtccgtggggtcacaaacagtcagacatgactgagagactgaactggactgacttggcgactaaacaacaaaaacagttatttctttatagcaggaggcatcaaaagcattttattcagtttaaaacattttccagaatcttaaatttagataatcccattttatgtcagaatttcatttgttgaagcagaaattttttttttttttaaatacttgggcattaaattattttgttcaatggagtgtaactgaggccaagaaatagtgctgtggggttggaccagtctgggaagcctggagccttggagtctaggtcctgctgtgcctctgtctaacagagcagtttgcatctttggcttcctatctctcagctttgttttcctcatctatataatgaggaggctgtactagaatgatctatagtgaaagtgttggttgctcagtcgtgcctgactctttgtgactccatggactatagcctaccaggctcctctgtccatggaattctgcaggcaagaatactggagtgggttgccattttcttctccaggggaatcttcccaaccctgggatttatcctgggtctcccacattgcaggcagattctctaccaactgagctaccagggaagcctgatctacactgcagaagaatgatctataagtttcttcctttaattaatctagtaaaagcaatcagaagtcgtgttgttttaattaagcattgacttgaaatggaaaattggatcaatagctgatataggattgtacaaagcatctataatgtgatggacattgacgacatcctgccgtttagagatccaggaccacaaaagagactaaagggaagtacagcccacattggctgctgctgcttaacagtcgttggtggctggcaggtggcacgttttgaagatatttttgaatcggctcacagaatcctaaaagaattaacacatgagcacgtgaacacgtaaccgcatctctggtcaccaacatttgatcgagaatcttattaaaacatatcactgatttcttttggcactacttcagttgctttcagtgaaaaaaatatgtcctgctatcgtcatttcactttggcttgtcctgttcactttcccccatcactgtgttccctttgcaaagcctttagccagccagaacttaaattaatcagggttgcatgtcagacgcagagttaggtgagcgaaatcccgtgatgccagctcaccgggcagagtttccaaggcaaccgctgttgtctgtgtcttcactctgaagggaaacctgggagaatctggtcctgacgtcgctctgaaaagaaccagcatggggtgaaacgatctgtaaatgagggactttggttccggcctggtgtttgttttattgctgtaaggaaaggtcgtattcacatttattttctctagctctgaaatgagggtttgaattgaactacttgtggatgggcaattaaaagcatatttaaaatatacacggactacagttctgagaatcactgatcttccaatgataaagaagggacagagtcagaattctcacaggaaaaagaaagaaattttacccttaaatgagaataggattagcatgggccaagatgcagaaaaaaaaagggcagagaacagtccccaaccagaacaccttcaagctcccaccttcaagtttctctccttgttaatgaatgagacgataacattttccaaaccaaggcacatgagagggtgaaagggggagattcaataattaaaggttgggtcaggatgagacataaaaaaccttcccaggcaagcccacgtgtgtatcacctgccttttgtgctgtatggtaagaaggctttggaacaaagatcccctcagctaatgcagtttgaaaactgctaggctcaagtggtgaagattctgtttcatctgatgagatctgttcgagtgggagtggaagagaaaaatggagaaacatgggagggtttgaacagccactcagggagacgtgacagggaatcaaacagaaacaaactgaaaaggcttggaagtcttggttgttgctaagggagcaccactttgggtgaccgcggtcagcagatttgtgatgtaatccagtaaagactatagtaactatgatttacctttgagagggtttctgggggagaaaatcccaacacaataaacgtggaaacagtttgtggttatgattaatcctattttctgtaaagaaattcactcaaaatggacatcaataagcttatgaaaaatgattattgctatcctcaaagaaataaactgagtttgccatatattgtgagctaataagataaactgaaaaggctgcagtccttttatagtgttaaatattttagctcaggtgtaaacatatgtttgttctttattcagatgaggtttcctaatggaatactctttttttttttaatggttatttattttattttttggctacactgggtctttgttgctgcatggccttttccctagttgtgacgagcagctggagctattctctagctgtggtgggcaggcttcccattgcagtggctacttatgtagccagggggtctagggtgtgcaggcttcagtgcttgcggctcccaggctctggagcacaggctcagtagttgtgctgaatgggcttaattcctctgagacatgtggaatcttcccagatcaggggttgaacccaagtctcctacattggcaggcatattctttaccactgagctaccaggaaagtcctggatgaactaatcttaaaagttttaaaaagtatcattttgatattcggcaaaactaatacaattatgtaaagtttaaaaataaaataaaataaaaaaaaataaaaagggtatattaaagaaaaaaaaaaaagtatgtcttactttgagccgctataacaaagtaccacagactgcgtggcttataaacaacagaaatctatttctcacagttctggaggttggaagtctaagatcagaggggcagccctccgggttctggtgagaaccctccaccaggttgtagatagctgttttcttgttgtttcctcacatggcggagagagagtcagagaactctccagggtctcttataagggcactaatttcatttactgcactaatttttattactctggcagcaaaggtctgtatagtcaaggctatggtcttcccagtggccacgtagtgttgtgacggctggataaagaaggcagagctcggaagaattgatgccttcgaactatggtgctggagaagattccggaaagtcccttgagtagcaaacagatcagtcaatagtaagggaaatcaaccctgaatacttattggaagactgatgctgaagttgaaactccattttggtcacctgatgccaacaactgactcattggaaaagtccctgatgctgggaaagactgaggtcagaaggagaagagggcatcagaggatgagatggctgcatatcatcaccgatgcaatggacatgaacttggacaaactctgggagatggagagagacagaggcctggagtgctgcagtccatgaggctgcaaagagtcggaggcgactgggtgactgaacaacaatttcatttgcatgcactccaccctcatgacataataggccttgcctcctaataccatcacaccgggagttaagatttcagcatatgaatctggggattcccctctggggaagggacagagaacaggcattcagatcattgaaaagtaatcaagaaatgtacttttgctgtagaaaaattagaaaatacaggtaactgaaacgaaggcaataagaccatctgtaactctaaacgctatcatatgttagtgtatatctttccacactatctcctaggcattttatttatatgtgtaattaagaaagagaatgatgtttggttgctgaaaggatactgatgtgagatcaatgtaattcggagttgaaaagagcattgactattttctgatcaattttggaggatctgaattgcttgtgtgtgtttgctcagtcgcatctgactctgtgtcacgccacgggctgtagcccgccaggctcctctatccacgggaattctccaggcaagaatactggagtgggttgccattttctcctccaggggatcttcccaactcagggcatggaacccaagtctctttactcttctatactggctggcaaactctttaccactgtgccacctcagaagcccaaataaaatgcataggaaatattaagttttccatgttaacaaatatatacttacagtattgttttaatgactgtatagtagtccatgtattgattagttcatttaaccaaactcctgacattagggcttcccttatgtctcagctggtaaagaatctgcctgcaatgagggaggcctgggttcgatccctggattgagaagatccccttgagaagggagaggctaccctctccagtattctggcctagagaattccatggactgagtgactttcacttccactttctttcctgacattagataggaggtggtttccaggccttttgtattgtagacaatgtggtgttgcacatcttctagtgaaatctttgtgcacaaagagtgaatggagccagagtgtgcgacacagcggtaggtctgagggctgagatctgccagctgtgggttctgttcgtgaatcacttgtggaatgaacacaggataacaacggaagaggagatggggattctggttcccacccaaacatacagtcctgagtgtgtcactcaaccatgccacggtttagttttcttattcgttcacagaaagtagagataatggatggacctgatccctggaatgagacaactgtgaggatcagatagggtaacacagtgtggaaaaaccaaagttgtaaagcagtgtactgtatagggatgtattcttttcttttaaaaatgctattttgccatgtttttttccagtgacataagcagcgaacatttatttcacatggttctggaggatgggaagtccaagatcaagctggcaacagattctgtgtaagaaccccttcctggtttgcagactaccatcttgtcttgtgtccttgtgtggcctttccttggtgagtacacgtgagggaggggtgaagagagagagagatcttatgtcctttcttctgcgtataaggtattaatcccatcttttttttttttctgagtcgcaggtagtttgtgttatgaagacttcatcttaatgttcaagtggatgaatgcaaaagtcttcatgaccgtaatgccagtggagcaggacaactgttagcctaagaagtagaagactaaaaagtaagttgaagttctgcatgaattaactgtaattgtcagtgaagctgtgcaacattaagtcatctagaactgtctccagtttttaagattatgtatttcggttgtgctggatctcggttgctgcacgtaggctttctctagctgcagtgagcaggggctcctctctagttgcagtgcacgggctcctcattgtggcggcttttcactgcagggcacaggctctggagtgtgagggcttcagtagttttggctcctgagctctagggcacaggctcagtagttgtgtcgtacggggcttcgctgccccatggtatgtgggaccttccggcaccagggattgaacctgtgtctcctgcactggctgctgattctttatccctgagccaccagggaagtctccgtttcctccaatttttgacattctccaggaaaaatggatttttttatgagctaatccacaaggtttgggtaatgtggtgcctgaatgggcacttttgggcagaagctactagaaactttcaggctaatcagacagcctggctgcttcccggatgactacaaaccgaaggcagagggagcttgcagctcgcagaggcagaacccttgctgtgtgatcctgggggcagtggagggggggttattccctccctggcccctcacccaccctcctgcccccatcagtcaggaggctgctctgaggctggtgagtgtgatttggacctgatcctgtccagcccaagagaaacagaggccagcctgctgtcagagataacaacggctgttggaagggaagtctggggaaaatatttgaaaaaagaatcctgggaattccagctccagtccagcaagggccccaaagggggcaggtcaggagcatgaatggaaatttgcagcctgaattaaccccaaagggacaagcctacagctggaaaccacatgcctcccacatagccgtcactcatccataggtgggaaagcaaagagtacagttccgttcaccagacacgaaggggtgtcaagccttccttctctctgacctttgtccacagcgtgccctgccctggtggcggggggcaccactcacaaggtgttctctgagatactgtgtcttggccgtttagggtctgtattaggacgctgcctcttgccttctcccctgctcttggagatggggagcacacagtagatgccctgcggtccccggatggaggcgtcaacagcgcagggcacagagaggagaggctgaggaccaccccctcctcaccatccccccccccccgtcccccgccgcctgccagcgatgcagcctgcaacgcctgcatggcaattcccaggctcctaaagaaattaactttctactcccgcccccataggaagatgcttgggtcagaaagaaagacaaatgcaaagttataaacacaacaattctgagttccctgataagtgcattatgaagcttgcatactttccatccctggagaggtccagaaactggaactcggtgtggcagggggccggctgagtcaaggaagggagggagccgaggctgtttctggttacaggctggaacaggctgaccagagcccactcgtttcactagagcagggacggacaagtgctaggctttttaaagccctttctttgttgtagatatgtctgtcgcaattattttaagttctcccagctaatttaagtatgatacatgtgtgctcagtcgctcagtcatgtccgattctttgcgaccctatggactttagcctgccaggctcctctgtccatggaattctccaggcaagaagactggagtggggtgccgtgccctcctccagggaatcttccacacccagggatggaagctgtgtctcttatgtctcctgcattggcaggcaggttctttccctctttacctgggaaacccaagtatgatatatagtgctgaccaattaaacatcccagtacatttccttacttcttttaaactattaacgtttgatgatgctgcggaagaaggggagccctattagtaaaattgacctttagtttatttgtgatttgtaaagaaagacttatcatacctgataaatagaagaaggagtggcctaatatagaccatgaacagtgacaggaatgcttctaagagtccaggagtcattgatccctggtgcccatagagacagtctcgtgcctgcaggaaatagagtctggaagagggcattcgtttgaggtaaatagctaactttgggggttgccttcaaatatcgagtttcttttttttttaactttatttttaaactttacataattgtattagttttgccaaatatcaaaatgaatctgccacaggtatacatgtgttccccatcctgaaccctcctccctcctccctccccctaccatccctctgggtcgtcccagtgcactagccccaagcatccagtatcgtgcatcgaacctggactggcaactcgtttcttacatgatattttacatgtttcaatgtcattctcccaaatcttcccaccctctccctctcccacagagtccataagactgttctatacatcagtgtctcttttgctgtctcgtacacctatttttgtttgatgactgcatttttttcagttgctgataaatcacaagcagagggacagactgatacgggtttatcctcttaaacgttaagttcatgaagagatgcacaaaagctccttttgagggctaagaggtcaaaggttatgtctctgttttgagctttccagatcccagaataaagtgcttaaggggaatcatttttgtttttttaatttgaagcatagctaatttataatgctgtcttagtttctagtgtacaacaaagtgattcagttttgcatacatatgaatgcgttctttttcatattcttttccattgtagtttattatacgatattggatatagttccctgtgctacacgatagggccttgttgtttatagattttatatatattggtttgtatctgccaaccctgaactcctaatttacctgtctctccttttccctttggtaaccatgaatttgttttctgtgtctgtgtttctgttttgtaaagaagttcatttgtatcacttgtttagtttccacgtttaagtgacagcatataggtccttctgtgtctgaccgacttcactaagtacgatcatctctaggtctacctgtgttgccgcaaatgcccttatttcattctttgtcatggctgagtaagattccattgtatatatgtgccatatattctttatctgttcctctcttggtggacatttaggggtttctgtgtcctggctattgtcaatagtgctgcagtgaacactggagtatatgtatctattccaatgactgttctccatagtggctgcatcagttttcctaaggggaatcctttcttaaggggaagtcacggttagtgacctaagaattggaggttagacaacctgaagagagggagtgtgggagaaaagaagaaatagcaagaaagacacagacagacactgtgagttgaactggtacttttaggaaccacagaaatcatccaggaacatcctttcctcaaggctgttcaccccagagagagaaggaagactcagggatactttgtagcctcttaagaggaaatttccttttggaggaaatctgttagaaagccttccttccttcccttttttttttttctctacagtagctgcagctcccgggctctagagcacaggtgcagtagttgaggtgaacgggcttagttgctccgaggtgtgtgggattttcccggaccagggatcgaacccgtgtcccctgcactggcaggtggtctctcacagctggacccacaggggaagtccccttctttgccagtccagggctcacaattctattggactttctgggctgagaaagcgggaagaggggtgagtaatagcagatgatcctgccaaggagtctgggtggttagagagaaattagattttagactcatgcagtcaacctatggacagcaagactccttctggaagccatgagattgcctctggacccctgctggggttgccagctttggagcggaaagacaggggactgcctgtgaggcccctgggggacagaagagacggcttgcggggtcccggcagtctggacatcagagcagagtgatcgggtctggagccagtggatcaatacgggaggtggtcagcatgccaattacacatacgggcctctccaaagataactggctgtcttcagggatttgttatggagagagagaggcttggctggtatagaacatctgtattgttaaaaaaaattttttttgttagtgtgtattttagaggtaagcggtgggagggaacccagtatagatattttcattttgtgaaaaaaaatatttcaggtgtgaatcaaggctctgctgcagctgctaagtcacttcagtcatgtccaactttgttcggccccatacggcagcccaccaggctcccccgtccctgggattctccaggcaagaacactggagtgggttgccatttccttctccagtgcgtgaaagtgaatcaaggctcagttaggttcaatgctgggggctggtgagctgttagttggctcatgggctggggctaatgccagggaaagagtgtccagtctgaagtttctgccttcttgtcaggactcagccatcttctgagcctcggtgttttcctctgtgaaatggggttgttgagaggctgagatgaaaactccacataaacattgtaagttctcaccaacaagttggggtgtttttccctagctgagggtagaagctccttggggtctccccttcatctctaagatggagtcagttatggctcccgtatgagagaaacacaaacgacgtcaatgagcgcctgctcaggatttttaattgcctttatgctgagtttttcttcatccctccaagccttttttggggagatgaggaaatatagtagatctacagagctctgtacatacaaagtactgaatggagggggagaaaaaaaagacccccctggtcagcctccctcctcaggtctatagaatggcagagaagagcaagtggcccctgcattgctctgtgaggccgtggtaagcggccagggtccccacccagacttcaggcagccatgttgaaatgcaagatggcgggggccctaacaaaccatccttctctctgccggcaaactctggagtctcgctcagcctgggaagtttaatcacagctaagcaaatgatcttggatttattttgagggccttccaaagccagaggggaaaagttattttatttttataaagaagaagaagaaaaaaaaaacccagtaaccctttgccagctgagatctttcttcatctttttttttttttttccctagtttcttgacttctgtaacttcctaagcctggtgggaggcgagttcactgtcttgaacaaagggtggtttatatcctttgctagaagacaaatggggggaggaggagggaatgagagagactcagagttcagatttttatttctggagaatatgaaattcttctggtgaagtagttgccctggtccataggttaaataaacatcacacatatgggaagcgttagagaggacttacagagtcacggggccaaaactgtgtcttattgttactgagggaaccagagaattccattgagagcctaggttaagatatttgaccccattaggtctgaatgaagaagaagggcagaaatatgaatgaatttctgatactagttttatttcccttgggctccagttgtgtgaacatgctgtgtatttgtctgcattctggtctacaaatgaggcctaagtccatgtgttcagtttaacttaacaagattttattgtgcacctatgagaagactcttgagagtcccttggactgcaaggagatccaaccagtccatcctaaaggaaatcaactctgaacattcattggaaggacagatgctgaagcaccaatactttggccacctgatgtgaagagccatctcctgcctggaggggaagcgggcaacggaggatgagaaggttggatggcatcactgactcaatggacatgaatttgagcaaactctgggaaatagtggaggacagggaagcctggtgtgtttcagtccatggggctgcaaggatcggacgtgactgagtgactgaaccacaaggtggggggcctggtgtagaagcacgggaagggtagggaatggctgccagaacaaaacaccgcagacaggggccgggaatggtgggtcttaaaccacagcagtggactgcctcacggtcctggaagctgggagtctgaggtcaaggtgtttgcaggtgcggtttcttctgaggccccccgccttggctcgcagatgtgggtcttcttgctgtggagggtctcagtcctcatctcctcttgcttcttggctgccttgggtctttgttgctgtgcacaggcctttctctagttgtggtgagcaggcccgagggcttccgcagttgcagcatgcaagctcagaagttgtggcacacgggcttcattgctccatggcctgtgggatcttcccagaccagggattgaacccatgtcctctgcattggcaggcagattcttaagcacctgaccatttagaaagcccttatttacctctttaaagatcctatatttaaacacagttccattctgagatcctggggattagaacgtccagcatgaactttttgtgatacacaagtttagcccggactacttaatggcctccagcaaagagccttgcaggggggtggggggtggctgggagacatgcccacagctgtctgctctagtggcagcctgaagtcagggctgggaacagagaagtctcttttcaaatgtgggtcctctccccttctccctgcaaagccctaggtctctgtcatcaaggagcttggagtgcgtcctcctctgggagagatggcgcctgcagccatgaaacaaacctggggaggatgcagccacgagactcaggagctggggtctgggtggtgtggctgctccctgagcgggtaagagatgtcacctttcgagtctgtttctcatgtgtgaagtggggcgggtaggtggaggtcagtgggtgcaatgacccgaggattccatgattccaagccatgtgttgtttaagggcagagtgccaaagtgaggggtaagtaattggtgctggctccagtccgtggagaaggttgtgtgcttgcttagcgcggggtgtttcccatcgtcttggcttgggctggagccagcaccctcctcatgcctgactgactttttttgttcaaaagcaagccatctctttttccttttgcaaaataaaaacaaaagccccccacaacacacaaaaaatacaaaaagaacccacaaccctccccaaacaaacaaaacccaaacaaggaagcttctgccctcggagccgaagcagcccgtgtttgggggcaggcttagagaaggcactgcctgcttgtctccatgggtgctgccctgtctgcctggctcagctctggttgactgttggggtccccctgcacagctccagattctgccctggaaatcccgaaggctggctactgagagagaaagctctagaaggagtctgccagggaccctggtgacaaggcaaatgacttagaatgagagtcagacaatccaagagaaggaaggtttcctcagtgagcctgctgttggttgacagttcacttgaatgacgaatggggcttttactttactcagaaacttcttgttgggatttgggggctcaataagccacaccctctcctccttgcctgaatcctgcagtatctgatgatcagaaaaaaagaggagggtgagcccctggggcacagtcatatttcctaatagaaactgtagaattagagccaggcctgtaaaaccgacggtaagaagagcagaccacacggtgtgtgtcccagatataaacactgtgggctgagtgatgctgcctgctgattctttccaacaaaagacacaagagtcactgagggtctttccagagagaggctgagtgttatgccaacaaaggtcctgcctcaggaaaggaggggcttccccagtggcttagatggtgaagaatacggctgcggtgcaggaatcacagaagacacaggttcgatccctgagtgtggaagatcccctggagaagggaatggcaacccactccagtattcttgcctagagaatcccatggacatgggagctgggaaggctacagtccacggggtcacaaagagttgggcacgactgagctattaagctattaagcacttctcctcaggaaaggaatggtaagaacagggaagaaaagcttctcctgcccactgctgtttccccaagacactcatccaagacattcaggtgtgagaactttgatgtgacagagggggcattcacactataagaccccggcggcttgacagcaaacatcagctgaacttaacaactgaatgtcagcagctggtgctccatgcctttggaagtcctatggcgagacctctgccagggatccctctctggtctcttccttcccaagacacagcctcctcttgtgttgcagaacactgtgcaacttgaagtgtgtgtgtgtgtgtgtgttaagttctttctgtcgtgtctgattctttgcaaccctatgggctgtagcccaccaggctcctctgtccatggaattctccaggcaggaacactggagtggattgctgtgccctcctccaggggatcttcccgacctggggatcgaaccctcatcttttacatttcctgctttggcaggtaggttctttactactagcgccacctgggaagcccttgaagggactcaaaattttcatttgttcattaaaaaaaattttttaagtgtatttatttatgcctgtgctgggtctttgttgctgcccaaaggctttctctggttgcagtgagcagggggctactctctagttgtgcagcacgggcttctcattgcagtggctccttgtgttgtggtgcatgggcttagttgccctgtggcatgtggggtcttagtcccccgaccagggatcaaacctgtgtcccctgcagtggaaggcagtgattcttaatcaccggaccaccgggaaagtcctccctttgttcattttaagttcaccccctcctctgtacctctaaggaacactgtgtctctgctaaaatctactttggctttcacccatcagcatctcagaagagccagtgggcactttgctctttctctctcctttgtctgtgtaggtggtagggaacaatttacatatttcctttcccactgtgatgaaagacgccaccttccattagacggcagaagtgactacaatcagtgtttgggagaattcatttacaggaagaccctgccatagagcactaagtgattccctaaacatttaacagggtaatgaagtcagtgatcagttaaccgattaagattttacttttgagaaagtcatgaattatagagctaaggtgattcttttttcaaattaaatccagatttcatttcgcttatgcaatagtccatcctttcctcactaatttaaattgctgcctaaattatttaccaaatatgtatgttgatctggtttgggacacttttatgtcacttgatctgttgtctgttcctgtgcccacggcacactttgaaaattgtgataaccttttggtatgataggggcttcccttctggctcagctggcaaagaatctggctgcaatgcaggagacctgggttctatccctgggttgggagatcccctggagaagggaaaggctacccactccggtattctggcctggagaattccatggactgtctagtccatagggtcacaaagagttggacacgactgagcgacttcactttcactatagtatatgctgacatttcctagagcaaattctcccacttttgtgccttttccaaattttcttgatttcaagtagggatttttacctgttgttgatttcttttttaaaaataagctttattgaggtgtaatttacgtacaaaaaagatcttcatgacccagataatcacgatgatgtgatcactcacctacagctagacatcctggaatgtgaagtcaagtgggccttagaaagcatcactacaaacaaagctagtggaggtgatggaattccagttcagctatttcaaatcctgaaagatgacgctgtgaaagtgctgcactcaatatgccagcaaatctggaaaactcagcagtggctacaggactagaaaaggtcagttttcattccaatcctaaagaaaggcaatgccaaagaatactcaaactgtcacacaattgcactcatcttacacactagtaaagtgatgcttaaaattctccaagccaggcttcagcaatacgtgaaccattaacttccagatgttcaagctggatttagaaaaggcagaggaactagagatcaaattaccaacatccactttccagtggatcatcaaaaaagcctgacagttccagaaaaacatctatttctgctttattgactatgccaaagccttggactgtgtggatcacaataaactgtggaaaattctgaaagagatgggaataccagaccaccttacctgcctcttgagaaacctgtatgcaggtcaggaagcaacaattagaattggacatggaacaacagactggttccaaataggaaaaggagtatgtcaaggctgtatattgtcaccctgcttatttaacttatatgcagagtacgtcatgagaaacactgggctggaggaagcacaagctggaatcaagattgccgggagaaatatcaataacctcagatatgcagatgacactacccttatggcagaaagtgaaggaactaaaaagcctcttgatgaaagtgaaagaggagagtgaagaagttggcttaaagctcaacattcagaaaactaagattatggcatctggtcccatcacttcatggcaaatagatggggaaacagtggctgactttatttttctgggcttcaaaatcactgcagatggtgattgcagccatgaaattaaaagatgcttactccttggaaggaaagttatgaccaacctagatagcacattaaaaagcagagacattactttgccaacaaaggtccatctagtcaaggctatggtttttcctgtggtcatgtatggatgtgagagttggactgtgaagaaagctgagtgccaaagaattgatgcttttgaactgtggtgctggagaagactcttgagagtcccttggactgcaaggagatccagccagtccatcctaaaggaaatcagtcctgggtgttctttggaaggactgatgttgaaattgaaactccagtactctggccacctgatgagaagagttgactcattggaaaagaccctgatggtggaaaagattgagggcaggaagagagggggacgacagaggatgagatggttggatggcatcatggacttgatggacatgggtttgggtagactctgggagttggtgatggacagggaggcctggcatgctgcggttcgtggggtcgcaaagagtcagacatgactgagtgactgaactgaactgaactgaactgaatttacatataataacattagtggaaaataaagttagtgtatgatttgatgggttttgacaaatggatacagtcacatgagcacagttataatgatggtatagaacgtctctgtcacctgcccttttgcagacagtctcctttttacctctggcccctggcaactgcatttcttttttctgtcattatgactccttgttgtagagttttatgtgaaggaagtgagacagtgtgtagtcttcagtgtctgacttttttcatttaacatgatggttttgagatcctccatgttattgcaggaaacagtggtttgctccttttcgttgctggtggtggtccattgtatggatacactgcaaatggtttacccagtcacctgaggatgggcatgtggattgtttccagtttttgagtgatattaataaaactttggatgaacatttgcatacagatctttgagtggacaaatatcaacatttcttttgggtaacacctaagagtgggattgttggttcatggtcatatgctaagtttatgtttacttttataagaaaaagttaggtgttttgctttcttggcatcctcaccagtacttgatattgtcagatttttaattttagctgttctaataggtgtgcttttgtgagatggttggatggcataaccaactcaatggacatgagtttgagcaagctccaggagatggtgaaggacagggaagcctggcgtgctgcagtccatggggtcacaaagagtcagacatgactgagcgactgaacaaaaacaaaggtgtgcttcccaagtggcgctaaaagacaaaagaattcacctgcaagccaggagacgtaaagagacataggttcaatccctgggtccggaagatcctctggataggaaatggcaacccactccagtactcttgcctggagaatctcatggatggaggagcctggcaggctatagtccatggggtcgcaaagagttagacacgactaaaatgacctggcgtgcagtgggtgtgctgtggtacctcatgggcattttagtttgcatttgcataaggactactgatgaacacctgttcatgtgcttgtttttaacccatattactttttggtaaagtgtttctgttcaagcttttcactttttaaaaaattgggtttgttttcttcctgccaagttttggagtttcttaatataatctaaaggcaaagctaaaggcaaaggagaaaaggaaagatacacccatctgaatgcagagttccaaagaatagcaaggagagataagaaagccttcctcagtaatcaatgcaaaaaaatagaggaaaataatagaatgggaaagactagagatccctgcaagaaaattagagataccaagggaatatttcatgcaaagatgaccacaataatggacagaaatcgtatggacctaaaagaagcagaagatgttaagaagaggtggcaagaataccccagaagaactatacaagaaagatcttcatgacccagataaccacgatggtgtgatcactcacctagagccacacatcctggaatgcaaagtcaagtgggccttaggaagtatcactatgaacaaagctagtggaggtgatggaatttcagttgagctatttcaaatcctaaaagatgatgctgtgaaagtactgaactcaatatgccagcaaatctggaaaactcagcagtggccacagggctggaaaggtcagttttcattctaataccaaagaaaaacgatgacaaagaatgttcaaagtactactgcacaattgtattcatctcacatgctagcaaagtaatgctcaaaattctacaagctaggtttcaacagtatgtgaaccatgaacttccagatgttcaagctggatttagaaaaggcagaggaaccagagatcaaattgtcaacatccgttggatcatcaaaaagcaagagaattccagaaaaacatctacttctgctttattgattatgccaaagcttttgactgtgtagatcacagaaaatggtggaaaattcttcaagagatgggaacaccagaccaccttacctgcctcctgagaagtctgtatgcaggtcaggaagcaacagttagaactggacatggaacaacagactggttccaaatagggaaaggagtatgtgaaggctgtatattgtcaccctggttatttaacttatatgcagagtacatcatgtgaaatgccgggctggatgaagcataagctggactcaagattgccaggagaaatatcaataacctcagaaatgcagatgacagcaccattatggcagaacgtaaggaggaactacagagcctcttgatgaaagtgaaagaggagagtgaaaaagttggcttaaaactcatcattcaaaaaatgaagatcatggcatctggtcccatcacttcatggcaaatagatggggaaacaatggaaatagtgagagactttattttcttgggctccaaaatcactgcagatggtgactgcagccataaaattaaaagacacttgctccttgaaagaaaagctatgaccaacctagacagcatattaaaaagcagaggcattactttgctgacaaaggtccgtctagtcaaagctgtggtttttccagtagtcatgtatggatgtgagagttggactataaagaaggttgagtgctgaagaattgatgcttttgaactgtggtgttggagaagactcttgagagtcccttggactgcaaggagatccaaccagtccattctgaaggagatcagccctgggatttctttggaaggactgatgctaaagctgaagctccaatactttggccacctgatgggaagaagggactcatttgcaaagaccctgatgctggaagagattgaaggcaggaggagaagggaatgacagaagatgagatggttggatggtatcaccgactcaatggacatgagtttgagtaagctccaggagttggtgatggacagtgtgcttcagcctgtggggtcccaaggatttggacacaattgagcaactgaactaaactgatatattctggatacaagtcctctttgtcagatatgtgattttcaaatatgtagcttatctctttattctcttaccagtgttttcagagagtaaaagttgttaactgtgatgaagtccagtttatcaaccttatcttctttgatgtcctgtctgtgctttgcctaaccacagatcggaaagattttctccttttttattctaaaaagtttgggctttcatgtttttcattttcgtttatgatctgtttgaattgttttttttttgtagtagcaatatgtgaggttgatgctaaggttctgtgtgtgtgtgtgtgtgtgtgtgtgtgtgtgtggtttttttttttttttggctatggatatccaggtggcagcaccatttgttgaaaaggtcatctgtcttcccttgagtcatttctgtacctttgtgaagctcagtttgtccttttgtgtaggtctgcttctgggtttgctcttctttttctccaataccaccttccctggtggctcagacagtaaaagcgtctgcttgcaatgtgggagacccaggtttgatccctgggtcaggaagatcgcctggagtaggaaatgggcaacccactccagtattcttgctgggaaaatcccgtgggtgggggaaactcataggctacagtccgttgggtcgcgaagagtcggacatgactaagaaatttcactttcacttttcactttcctccaataccacactgtcccagggagatggatgaacaaatgaacagagagttcactcacttgttaggaatcctctcacacctatagtggcagagttctcttaagaaaatcccatcaacagaggaccctggcagactacagtccatggtgtcacaaggagtcagggatgagtgagtgactgagcacatactcccctaagacactgatgaagtggaggagatgtgtgtgtgctcaggcatgtccggcctttgtaaccccagggactgtagcccaccaggctcgtctgtccatgggatttcccaggcaagaatactggagtgggttgctgtttcctcctccaggggatcttcccgacccagacatccaatccttgtctcttgtgtctcctgcattgataggcggatctgggaagcccttaagacagggcagaactggcctccccactgtgtatctttgctgcctcttctttctatcacagccccacagccctatgagtcttttgagggcaaggatggtgacattccttttgtaagcccagcccagggcctgtcacagagagggtgctcaataatatttattgaataaaatgagtaaccacggaccagctgaacaccgtctatattcaagaagtcacattctgtggcaggctttttgctcatagaatagctgtcacgaatgaggagcagacattttgcagtgcagcagtggtgagaaactttttttttaaagtataatctaattcaggtgaagaaatatgtttatgtcctgtgacttttattcccaaagtgaaatggttagattaaatcctgtgggggtgggaaatgacgttgttcttgtatctgatgcctgtatgtgcttagtccacgtctgactctttctgactccatggactgtagcccgccaggctcctctgtttatgggattctccaggcaaggatactggagtaggtggacatttcctcctccaggggttcctcccgatctagggatctaacccaggtctcctgcattgcaggcagattctttattgtctgagcctattttattcaataaagggatgtgaatgaggaaaccggccctgttttacccttctaaaatgtccatattcgggtagatttgagaagtgacagtggtggaaattttatcatccttactcctgaagtggatcacagcttttactgggaagccagtcagtctcaggctgtttctgggtggcgtaaaggtgttttttgtttttaaaataagaacttgtcaagaaatcagcagagcagagttgccttgagccttcagtgagacatgaagtagcctgataaggcagtcgttcaaaatggtgctcttggtaatgaaatgttgcctgtgatgcctccgagctatggagggttgacgtacgttctcttctgcgcatcaagggaggaaggggtgtcagaaactcagcctgagaatccctggtcccttctctgatgctattttccctacttccaagagttgggtccagcagacaagtgacaagcctggggaagttgactctgagtctctctaagctttcaaagattttgtgtctcttccttctcaaaaggggaaatacgcaggatgtaacacctcatcgaagcagtgcatcttcattgatggagaagggtgagtgagtgaccattttcacgctgccactttggtgtcacatctgtggacattggccctctcaccttcttgtgcatttctgatcatagactagacactttgcctcttcaaataaagcagttcttcattggaaggttgcttggattttaattgtgtttcctttggtgggtgaagaatttgtttgcttcaacttattttattcaagtagagttgacttccaatgttgtgttaatctctgctgtgtagcaaagtggcggagtttcggttatggtttatcacagaatattgagtatagttctctgtgctctgcggtagaaccttgtgtatccattctccgtgctgatgccaactcccaatccatccctttcccactccctcctcctcagcaaccacaagtctgttctctgtctgtgagtctgcttctttttcattgataagtttgtttgtgtcatactttagatgtcacatgtaagcgctctcgtgtggtatttgtcttctgtttctgacttactccagttgttatgctctaggtctatctgtgatgctacaaatggcattatttcattcttttttatggctgagtagtattccattgtgcctatacaccacatcttctttatccattcatccgttgatgagcatttatgttgcgtccatgtcttgactattataaatagtgttgctatgaacacagggtgcctgtgtctttttgaattatagttttgtctggatataatgcccaggagtggaatcactggatcatatggggttcccaggtggtgctagtggtgaagaacctgcctgccaatgcaggaggcataagaaaagcgggttttgatccctgggtctggaagatcccttgaaggagggcatgacaacccactccagtgttcttgcctgggaaatctcatggacaggggagcctgaccagctatagtctgtaggcttgaaagagtcaggcatgactgaagtgacttagcacgcatgcagtatggcaactctatttttagttttttgaggactgtccatactgttttttgtagtggtttcaacaatttacattccctggttggtgaagaatttgaagttctactttacacaaaatgatattacttgaatctgacagtgaacagtcaaagctatgaaaccgcataggaaagttttgaacgggtaagtaccctctccactgactttgaaaagaatgtgagtataaaatcactatggcctttctgaaaacactgaaagccaaatacaaccttgacatttaaatgtgactttgaagggtaggaccacatttcagcaacttaagtggcctcatttttttctttaaagagaaatatctaaatatttaaccagcatctgtcaagtcacccagaagtgagccatgaacaagatttcctgtgttatggggattgtagtggctgctaggaaaataacccacagataaatgaatccaggaattcatttgtgcaaatgggctctgccatcctggttcactgaaaaataggctctagacacattttcttgagtaattaaaaaagaaaacaactaagccatccaatgctcaaaatagcaatgaaactgtgacttaaataaacctctcagacatggatacttgtggcagtttatgtgtatagagcatgtgtacaaatataagtacgtagatttgatcagggagtcaatttttattgtgtacctgagtcttatttaagcctgacaacaatgttgtgggctgctattattcccatctcacagatggagaaactgaggctgtctctctctctcaacttttgcccagcgtcacataactggttgttgttggttcttttcatctccggaccctcctagcacaatgagttgtttgttacgtccaacaagtttaccttagataccaaactaacacaatgggctatataacctatactgtaataggtttataatatttcacacaaataatacattaaaaaacacaaaaaataaacattttaaatctcatagtacagtaccaagaaaagcatggtaatacagtacaacagatggcatacaggagctggcatcgagtgaacaggcaagaagggttactgactggaggagggagtggaggtgggagacggtagagctgaaggatcgtcagcaacgggagacagagggcaagctgcaatgtcacttctgcctgacgctaatgggcttccatgatggctcagatggtaaagaatccgacttcaatgcaggagacctgggttcgatccctgagttgggaagatcccctggagaaaggaatggcaacccactccagtattcttgcctcaagaatcccatagacagaggaacctggcgggctacagtccatgggatcacaagagtcaaacatgactgagagactaaaccctaatggggatggcactggttctggctccttgctggcaccagatgcatctggcaccagatggaagttcaccaattgtgggctcacatgtagggggcttactgtaccaagaagcagcagaagtctgtggttcaggaaatgtgattgggaataacccaggagccccttgcagtcaagtcacactggcttttttcttttaaaccacggacacgactgaagcgacttagcagcagcagcagcaagcccatctccttaggaaatgctctcgacatgtccttaacgtgcccatcctgtagcacttttcgtccatggaggaaagactgatggtgaagctgcagctccagtactttagatagtgatggaggtttgttcatgtaagaaacggcaagcgccaaaccggagggcgggatgcagcggaacccttcccccgttccgttttcttcctcttggctcctgtggccagaatactatcaaagtttcctgcggacacggtccgttgagaacctcacacacagactggtcctttcactgggacctttctgtggtcagagtcatgagtaacagagagggcccacccaagaaagggcaatgatggcgattctttcccctcttcagctttcttctcaacatttctgggtgaaaatgattggaattttagtcgctgttgaaacaccactatcagctaggctctgaagatttttttttaggtgggcaggaagagaaactgcatagatggcttcaacttcaagttcaggtaatataaccttccccctgtcccaggctcctgtctccccacaagaaaacaaatttgtgatgactataatacttgatctttgtgctgggaatcaacttctcctggtcatcctgaaagcaagagtagaaaagagataccttggaattgtataaatgctttttcttttacaaagtccctccttcatccctattaaaagggttgcgtttctatgttaagaagaaagtaaaaattacatatagtcccactgcacaggtataaacactaataatatcttgctaagatttctttccagtgcacatatatgattttttttaaacaattgaaattaaaaagtcaatgtatgtcatagatacactactatgtataaactagacaactaatgagaatgtgcttgagaagacccttgagactcccttgaactgcgaggagatcaaaccagtccatcctaaaggaaatcaaccctgaatattcattggaaggactgatgctgaaggtgaagctccagtacttgggccacctgatgtgaagagccaatctcattggaagagaccttgatggtgggaaagatggagggcaggaggagaagagataggcagagaaggagatggctagattgcatcactgactcaatggtcatgagtttgatcctggatatagttgagcttatgcagatctaagaaaggttttttttgttattgttgttttttttctcccaggaactaatcctcacagtgtgaagttggaatgattatttagacattttgggaaaaagccaactgccttgatctggaggactcctaatgtcatctttttctccccatggcacccagactctcccctccctcttcttgacagcaacaacagtcaaaggcaagcatgcttttgacttcagagaagtccttggaggtggtacagtcattaagatgcagaagctgttacccaaaatctgggttcacctcttggtgggtgaagagccagaagacccaaccaagtcacggatcaggggacggaaggatttattattacttgcagcaagtaaagagaacactggggatctttctcaaaatggtatctccctgagcagcaaaattggggcagttttaagctaagggtacatgcatattcatgaaggagcatgagcggtggacagaatccaagctttaattggtgggagtcgggagggtcagagaaggtcaacattctcacccttaggttccaggtgatctgggggttgagccttcaggctaatctttaccactgaaacaggactggagtctttacagctgggagcctctgctgttgttacttctcttgcctgacaatatcgtttgttcctgcgttctattgttcccttaagatcattgttactgagatctgttcaaggagacttgtggtcggtcttagatcacaaaatagcttagactgtcaatggcttcatttctgtcagaaagccatgcctggttctctctctccagggaacccctgccttttctggttacagagagacttggaacccctgggtctctgaggaagggaggggtggcatgggctagaaaaactagggtgcagtgaggacggtattggggttgactgaagaaggggcaaaggcagaattgagaggaaggggtgattacgagtgttacagaggaaaccacaaatccaaaatggcaacacttgtgctaaagcccctgagatccaacctagatttaatctctgccctaattgcaattttgaccttcctcaggaatgtattcctaatgggctagtctggaattttctggtaagaaccaatgaggtaatctgtctcctgggccctctccacgcacccctgctccctgcatcatagactcttgcccttcccccaaaggaaggtcacccgaaacagtccttgttattttccatctttcttgatagcttccttgccccaccctccttctacctgtaaaagccttgtatttttgtacagcctctaggagaattcttctagttaccgcatgagattctgctcaactcatgaatccttgagtaaaaccaattggatcttcaaatttactcagtcgaattttgtttgttagaggggaaaagtcagcatggcagagaacaggcttcttttgtccccacgtcccttccagcttgctcacagcaaggcagggtcatggaacgggtcatgattaaagtaggtggaagcagggatgcccctggtggcacagtggataagaatccatctgccaatccaggagacacgggttcagtctctgatctgggaagatcccacctgccgcagagcaactaagtttgtgctctagagtccgggaactgtaactactgagcccacaggctggaactgctgaagttcacatgccctggagcctgtgcaccccgataagagagcccatgaactgcaaagagtaaccctgacttgctgcaactagagaaggcatgagcaaagcagtgaagacacggcacagccgaacagaaacaagtaattaattaaaaaaataaagttgatgaaagtaatgtaaatcacctctgggttgaagcaaagaggagctggtatgtgggcctccggccgcctcttcccctgtggcagggcctgaggcggacttgtgttacagatggtgcaccccagatctctgacagactccatggacttttggcagaagagtgtgtttagccactgagatttaggggtgtttgttactacagcagagcctaccattgcctgactaatttggctgcacacagtcccatgatggagacttaaaatgacaggaccttgctgtttttgtttttcatgtggggaggtgtgggcaaagtgcccactggcacaggaggggacctaccatgggggcttcagaaaatggctttctagcctcaggaaaagagatgagtgaggagaaactgcttttttcccttcttaaaaaaattttttttaattaaaatctaattgacataaccttagttttagctgtctaacttaatgatttgatataagaacatattgcaaattgatcactgcattaagcctatttatatccatcaccacatacagccatgcatttttttttttccctttatgaggagaacttttaagatctactctcttagcaacttttcaaatatacaatatggtattattatggtcaccatgttgtatattacatccctatggcttatttgttttgtaagtgggtgtttgtacctttctgttttttgacaaatactgttatatgtggatatggtgcttggggcagtggcagcttccttgtgaccgtgaggggagacgtcactggcattctaagaatgggagcgcagagaatggaaagcatctgggtccttagcaacatcgtaaagccaatgaaccccctgggcctctctgcttgtctgcttttgattgagtcggtttagaatgtctttaccattttaacaacttttagggttcttcccctacttgcaaagtattttgtctgtttaatgttaggtagtacactaacaataaaaccattaacattatcatttttctaactattaggaatctaattttatagttttgttatttgtcaaaatgctaaactagaaaagggcagggctttaagggcagagcttattttccaaatattattgttttataaaaggattcatcagatagagttgtttcaatgagcagtaaactgtgtgcactttagtgatgaattataaggtgaaagcattaggagccatctgtaaaggggtttgattctcaaacctaagtgaggcttaatgacagtgaaatacttggggcttagctcaagtgttcagtaaaaggcagccattagtaccattatgcttatggcaatggtgctgtactttttgaagaaagattccactggcaggaggacaggaactcggaatctgtcaggctagatgttatatatatagcaacaacctggcaacctctgtggcttgcagcaacatcaaagtttatttctcatgctgcaagctcatctcaggtcagccaaggctctgctcacatcctctgcagttcggagctgatggagccgcctctgtctagaacatctttggtctctctgcagagcgaggagagaggccatgaaccatatgctcctttaaacttctgcctaaaagtgagacacatcacttctacccccatctcataattaaagcaagttgatggttgggagtgggacaccccaaaaggaaggcagactttggtgaacagtaatataatctaccagaggcactaaatgggggtgtttgagacctttacgtctgctcagtgtccctaaaaaggacagtgcctttctcaggccgttacccacattcctggtttctctctctaacaaccgtcccctaatatccactctcttttttctctcagaaatagaatgccaaatttttagctggactcatggctttcacgttttcaaagtgcatgcgtgtgtgctcagtcgtgtttgattttttgcaaccccatggcctgtgtcctgccaggctcctctgtccatggaattttcgaggcaagaatactggagtggattgccatttctttctccaggggatcttccccacccagggattgaacctgcatctcttgcattgacaggcagattttttaagcactgtgccatctgggaagtccccagctttcacattgcaccctctctttctcagtctcctgggtagttaggtgtggctatgaatctagctgtccatcagtggaaagtgcaccaaggtgatatgtgatccagatcattcttttaaaaagaaaaggcagatcctgcctccgcgatcctttcccacctccaggtagctgaactgtagcagtgtgctagaccatcagtggacaaaagtgacaccctagggataatagatcaacaaggtactaggagtcaacccctagagatctacaccatagagtcacgctaccagcctggacttttacctgtgagataaataatttcatttttgtcattatttttagttttagttcagcagtctttcccatttcctacccaaaactcttccttttttttttttccaccttggtaaaactcagctggcattaaacaataggatggggaaaagcaatgttatatttagtaaaaaagacgcccaactgcagccagttccctgatgctcttaagacagtgcaccaactgcttaactagctcacccagccaaggagtgtgagaaaagcattcagctattagacatgacagcttcttggagtaaagatatacttttgaaacttcaccttttttcactttatcctgcaggcgtccttactacagaaacacttgtcctaaacggtggactggggaagaagaaatatagacgtacaggtctccaaaccatacctaaaccctgtgtctcgacagtgaagtcacaaggctgcttactctccttcgtctttgcagagagtgagtgagaggtgagggactcagtctgcctgactctttgtgaccgcatggactgtagtctgccaggttcctctgtcaatggaattttcctggctagaatactgcagtgggttgccatttcctactccaggggatcttcctggcccagggattgaatgggcatctcttgcattggcaggagattctttaccgctgagtcactggggaagcccttggcagatcatctaggcttctagcttctgtattgatctttccttttgtgctgatgtaatctctcctatttgttagtattatgtccaggagagatattgactagatttcacctcatgtatcaactcatatattgatagtggctgcaatggtgtctgtgttgagaaggattgtgtacacatcttagactgggttccctgaagcagggattctgatgctctgggtttattgagggtagtgtctggagaaagggagtgagggaagccatcagggcaggggaaggagctgcagaagagtgtggtctcagtgcagcctgatcccacaggagtcctggaacaggaatcacatctcagagttggtcccaccttgagccaagagcccccttcttttgtggcccctgattagtcagttattggatgtaggctgccttgggggagctacctcccacttcactgagggtgattctctagagatgagagcagctgtgaactcgcagtagccgacattcatagtagctgggagatggatatgtgtagtctctgataaaaatttggatgggacacgaacagcatttgttagtctgcagtcacactcaggggacaagttttgtgatcaattatccatatcttccatgggtatgcactctaatctctgtagcagttcatgctatgagaagagaaagggctgaaataaggtctgctctgtcaacatccctactaagaagtttggttaggaagggcatggaaattatagaataagatttgtgttatggcccaaccattgccttataactgaagaaggaaatggcaacccactccagtattctggcctgagaaatcccatggacagaggagcatggtaggctacagtccttgggatcataaagagtcaggcacaattttgtggctaaaacaacacattgccttataaattgaaagctgttgttcagttgctcagtcatgtccgactctttatgaccccatggactgcagcatgccaggcttccctgtccttcaccactgaaagctgacatgacctatttcctgaggacccagatgcagaacctgatggtgaagtcctttggctgcaagcaacataattcatccctgggtaacttcagcacatttgggactatagaaaggaaactgggagaccttgcagaatctaagaaagaccataaggctgagcaggaattagggctacctcaggaaccccacagcagaatcacacgaaccacttcctagggtggtgctgtaacacttaacctcaaccactttcagtctctatacttctgtttctcttactcttttaaatcagcttttaattttagaatggtttcagatttactgaaaagttgaaaaaatgttagcaagattccctacacccagtttcttattgttaacactgttataatgcataatcacagctagtgaactgatattgaccccttcctgctaacgaacctctatagtttattcagatttcctaggtttttacccaatgccattttccgtcccagcatcccaccaggcaccagatacttttagtagtcatgactccataggctcctctagactatgcgtttccaaacttcccttgtttttgattactttgacagttttgaagagtgctgctcagggttaaccctaacctttaactttgtgtttcttttaaattttggcccagtttgagtccaaaatcttcctcctaggagcaaatgactgttgccaggggcaaaatggaagcagaacaaggccatgggggatcattgtgaatcccagccactccagtttggagtttatgcttacaacctgggatcaaagcacggatccttccctgcaagattagatgacctgggtcacaactcccagcaaaatgattatatgtgcccccaaatagtaaaacaagtagcacagaactgatggccacagtcaagcaattacaaagaagaaacctcagtgattctggccagaaccaaacgtgtgactgctacatactttattctctgtccctaagcttgaaacagtaaggggcttccctggtggcccaatgcagggggctcaggttgatccctggtcagggaactagatcccacatgccacaactaagacccagcaccaccaaacaaaacaaaatttaaaaacaaaacaaacagaaaaaacaagccagtgagtgtgaaattcctggtctattgctacagtataatcattttgattatactgttgcaggaagggggaccactttcaggccccaagagtgggttcttgtctaacactgggacaaatgaattgtcctaggaaacacatgtgttgacaaagcaagagattttattgggaaggggtgcttgggcagagagcggtggggtgagggaacccagggtccttcctggtggtgatacatctctcagccaagatggattccagtgtgaaggattctgggaggttggtcatctcctccctcctccttttggcccttctcaaattctcctggttagttttccctggcagtacctggttctttatcaggacctcctgttgtgagtcagctcttcgcatcagattggaaaagagcctaatgaagggaaagattgagggcaagaggagaaggggacagcagaggatgagatggttggatagcatcactgactcagtggacatgagtttgagcaaactcagggagatagtgaaggacagggaagcctggcgtgctgcagttcatggggtcacaaagagtcggacatgacttactgtctgaacaataacacacctgttgtgagccaactcaggcaagcggttaccattgtgcctgactatggcgggcagttttggtcaatgattccctaaatcattgcagaaaacactttgttttcccccatcaacaaaatagcaaaccctcaaacaatagtttcttacaagatacaattaatttgttatttctcttgtttccctctcccaccctagccctgaagattacagaataattgacatgcacagaccttggttaaaaacaactgtagaggaaaattcagaaattcgattcatctctaaataggtcacttgcaaagaaaagaaccgaagtgcttgctgaactgagctgaactctttggagtccttgattcaggcaggcctttatttagaaaacaaagaattcatccaggaaaacaattaaattctggcctatttaaaacaacctgttgctcttttgtaaactgagctattctctgtttgcacaggacataaatgttggggggatttagacaattgcccctttgtggctatattctgttttcaaattgctgcgtaagtcaaaggtagacaagataaaatgatggtctctaggtttctgatgattcattcctctaaactctagtaaataccctgtagagaggagaaaggaaagacacattctaaggccaccatttttttgtttgttctggtaacagctttattgagatataattcatgtaccgtagaatttacccatttaaagtatatgattcaatggttttgactccattcacagagttgtgaaatcatcaccacaaccaattttattatttttaaaatttttaagtttttggccactccatgtgccttgttagtctctcaggcaagtctgactctctgcaaccctatgtagcctgctaagctcctctgtccatggaattctccaggtaagaatactggagtgggtagcccttcctttctccagaagatcttaaacccagttctcttgcattgcaagcagattctttactttctgagccaccagggaaactaaaaaaaaaaaaaaaaaatcactgcggatggtgactgcagccatgaaattaaaagatgcttgctccttggaagaaaagctgtgacaaacctagatagcaaatttaaaagcagaggttttgccagcaaagatccatatagtcaaagctatgatatttccaatagtcatgtacacgtgtgagacctgaaccataaagaaggctgactgagaagactcttgagtgtcccttggactgcaagatcaaaccagtcaatcctaaaggaaatcaaccctgaatattcattggaatgattgatgctaaagctccaatactttggccacctgatgcgaagagctgactctttctgatcagctgactctgatcagaaaagactctgatactgggaaagactgaaggcaaaagaagaaggggatgacagaggatgagatggttggatagcatcattggctcaatgaatttgagcaaactccgggagatagtgaaggacagaggagcctggtatgctgcagttcatggggtcacaaaaagctggacatgatgacttaatgactgaataacaacatataccacgttttatgtatccatttatctcttgatgaacatttgagttatttcccttttttttggctattgtgagtaggctcctaggattactttttgtacatgtttctgagtgaacttatttttttcccccttagatatatacctaagggttaaatgtcttccctggtggctcagatggtaaagcatctgcctacaatgcgggagacctgggtttgatccctgggttgggaagaccacccccctccaaaaaaggaaatggcaacccactccagcattcttgcctggagaatcgcacagatggaggtaggtcataggttaaactgaatcttttgaataatataatgtaccaactctgggaagcagattctttcccctctctaaggtttgtttttgttgtttagtgaattttctgaattaattctgtaaagtctatattctttgtcatgggtggccatgaaatctgctcacttaccttcagttcagttcagttcagttcagtcactcagtcatgtctgactctttgtgaccgcatgaatcacagcacgtcaggcctccctgtccatcaccaactcccagagttcactcaaactcacatctatcgagtcggtgatgtcatccagccatctcatcctctgtcgtccccttctccttctgtccccaatccctcacagcatcagggtcttttccaatgagtcaactcttcgcatgaggtggcctaagtactggagtttcagctttagcatcagtccttccaaagaacacccagggctgatctccttcagaatggactggttggatctccttgcagtccaagggactctcaggagtctcctccaacaccacagttcaaaagcatcaattcttcgacgctcattaccttagcagtatcctaatgattgaacagagattccttaaatgccgagaaccaataagtctctaagtttgtgaggggctctgtgtgtgtgtattggagggtgtatcttcaacactcaggcaagtagtttacaactttgccttagcatttatttcctgcttgcagagagcctcaaggtcagtccgagttgagagtttgagaccttttcaggtctcacctgactgtgacacagctctgggcacgctcacagtcctaggcatgtgtgtggctctccagagccaggaatgtgtcaggtttttgcaaagtgccatctgaataactcatccccctgccttgcctcttaagctttgtgattggcttattgtctgcccctactgtctctggcaaccatgctgttaaacaactgtctttgattatttttgataaatgtcttgaggaaaaagcaaaacctgtttgcgtttggagagctctgagttatgtcaaataaagatggtcttgttagtaagtctgaaaacactaggtgacatttcaggggctctgaggagctccagtgctttatgtctcagagcagagagaattcagcaagaggcaaagtgatagacaagaagtgatttattagagttgtgacgcttacacgtgggtggtggagagagggctgtaccccaggaacttagtgggttatagttttataatcaggaaaagtggggagggggaaaaggccaccttcttcctcattcttgagtagatgtcaggcttccatcatcggctcttcctccacatcaggtgggggagttttcctctccctgcatggtcaagccgggattgtcatggcccatggaaatgagcaaaaaggcagtgacctacgctgtaaagggtaagccatctcaggttttagtatgatgtcaccttgtccttatatttttgtttttagtgcatgcagaggagcatgcttggaatcgttaacttactgagctctttgggcaggatatgtgtctcatgtcattgtttttattgtttgggggcatatctcatgcttctgttgcatggttttgttgctaagcaagcctgcttggctttatggttaaataaacctgcttttttgagtgatcatacaaaggtctcccatacgtttttctttacttatcatcccctagtgggattaactatttacttactttatctctttcgtgtgtccctatcaagttcttccggagccaccagactggtcaaataatgatagttctctagaaatggggctttgaaggcattccaaccctgttctgcccttttcggtgtctgccaatctgctgattttcactgtgactctgagctattggttttcatgagtggatgggactagagcaagttaaagtgctacaaagctctctgttcttaccaaggctcagccgtttttttctttataaatgcacctggattgctgctagcctttgactaatttttatgtttttgaaacatttgattctgacaatttttgccagtgtttttatggagagatggtatttcagagattcttgggccactttttttttggggggggggccactttttctttttttttgctgtaccatgagacttgtggactcttacttccccaaccatggatcaaacccaggccctggcactgaaagcaccaagtcctaaccaccgaaccaccaaggaattcccactgattcatcatttttgctgacatcccacacagtgattttttaaaattagtttatttattttaattataggctaattactttacaatattgtgatgggttttgccatacatcaacatgaatcagccatgggtatacatgtgtcccaccatcctgaaccccctccatcttcctctctaccccatccctctgggttgtcctagagcaccagctttgagtgcctgcttcatgcatcgaacttgcgctagtcatctgttttacatatggtaatatacatgtgtcaatgctattctctcatatcatcccacactgcccttttccagagtccaaaagtctgttctttacatctgtgtctcttttgctgtcttgcatattgggtcatagttatcatctttctaaattccatatatatatatatatatatatatatatatatatatatatgcattaatatactgtactggtgtttctctttctggcttactcaccctgtataataggctccagtttcatccacctcattagaattgactcaaatgcattcttttttaatagctgtgtaatattccattgtgtatatgtatcacagctttcttatccattcgtctgctgatgggcatctgggttgcttccatgtcctggctattataaacagtgctgcgatgaacattggggtacacatgtctctttcccttctggtttcctcagtgtgtatgcccagcagtgggattgctgggtcatatggcagttctatttccagttttttaaggaatctccacactgttctccatagtggctgaactcgttttcattcccaccaacagtgtaagagggttccctttactccacaccctctccagcatttattgcttatagacttttggatcgcagccattctgactggtgtcagatggtacctcatagtggtcttgatttgcatttctctgataatgagtgatgttgagcatcttttcatgtgtttgttagccatctgtatgtcttctttggagaaatgtctgtttagttctttggcccactttttaattggtttgtttatttttctggtattgagatgtatgagctgcttatatattttggagattaattctttgtcagttgcttcatttgctattattttctcccattctgaaggctgtcttttcaccttgcttatagtttccttgctgtgcaaaagcttttaagtttaattaggtcccatttatttatttttgcttttatttccattactctgggagccatacaatgatttttatggtgatggcactgtaaagttttggaaatcccttagaattttagacttcttattatagtctaaactttgaaatcctatcttgctaactttttattcacctagagtttcaaacgatcttcccaggtggtgctagcggtaaaaaaatatctgcctgcctatgcaggatacacaggagacacgggtttgatccctaggtctagaagatctcatggaataggaaatggcaacctgttccagtattcttgcctggaaaattccacagacagagaaacctggggcctacagtccatgaggttgcaaagagtcagacacaactgagtgagcacagaatttcaaataaatgggaaaacctaccatcacacaacataaactgtgtctttccatttttggttcagatatctaaatcactctaatcatgaaaaaaaatcatcacatgccagggaaataggtgactaatggctaatcagaataatccaggaatgtgaaagtcgctcagtcatgtccaactttttgtgacctcatggactatacagttcatggaattctccaggtcagaatactggagtgggtagcctatcccttctccagggcatcttcccaacttagggattgaacacagatctcccacattgtgggcagattctttaccagctaagccaccagggaagcccaagaatactggagtgggtaatactggagtggagaagggcctgtccttctaggcctatcctatttctgggatcttcgtgatgcaggaatcaaacctgggtctcctgcatcgcaggcggattctttaccaactgagctatcagggaatatagttatagtccaggaggctctttttaatcctctccaggacaaagggcaaaggagaaagtcagcagtttcagttcagttcagtcgctcagtcgtggccaactctttgtggtcccatgaatcacagcacgccaggcctccctgtccatcaccaactcctggagttcactcaaactcaggtccatcgagtcagtgatgccatccagccatctcatcctctgttgtccccttttcctcctgcccccaatccctcccagcgtcagagtcttttccaatgagtcagctcttcgcatgaggtggccagagtattggagtttcagctttagtatcattccttccaaagaacacccaggactgatctcctttagaatggactggttgtatctccttgcagtccaagggactctcaagagtcttctccaacaccacagttcaaaacatcaattcttcagcattcagctttcttcacagtccaactctcacttccatacatgaccacaggaaaaaccatagccttgactagacggacttttggcaaagtaatgtctctgcttttcaatatgctatctagattgatcataactttccttcccaggagtaagcgtcttttaatttcatggctgcaatcaccatctgcagtgattttggagccccccaaaatagtctgacactgtttccactgtttccccatctatttgccatgaagtgatgggaccagatgccatgatcttagttttctgaatgttgagctttaagccaactttttcactctcctctttcactttcatcaagaggcttattagttcctcttcactttctgccataagggtggtgtcatctgcgtatctgaggttattgatatttctcctggcaatcttgattccagcttgttcttcttccagcccagcatttctcatgatgtactctgcatagaagttaaataggcaggatgacaatatacagccttgacgtactccttttcctatttggaaccagtctgttgttctatgtccagttctaactgttgcttcttgacctgcatataagtttctcaagaggcaggtcaggtggtccggtattcccatctctttcagaattttccacagtttattgtgatccacacagtcaaaggctttggcatagtcaataaagcagaaatagatgtttttttttggaactctcttgctttttcgatgatccagcggatgttggcaatttgagctctggttcctctgcctttttaaaaccagcttgaacatctggaagttcatggttcacgtattgctgaagcctggcttggagaattttgggcattacttgactagtgtgtgagatgagtgcaattgtgtggtagtttgagcattctttggcattgcctttctttgggattggaatgaaaactgaccttttccagtcctgtggccactgttgagttttccaaatttgctggcgtattgagtgcagcactttcacagcatcatcgttcaggatttggaatagctcaactggaattccatcacctccactagctttgttcgtagtgatgctttctaaggcccacttgacattccaggatgtctggctctaggtgagtgatcataccatcgtgattatcttggtcgtgaagatctttttagtacagttcttctgcatattcttgccacctcttcttaatatcttctgcttctgttaggtccataccatttctgtcctttatcgagcccatctttgcatgaaatattccctcggtatctctaattttcttgaagcgatctctagtcttcccccattctgttgttttcctctatttctttgcaatggtcgctgaggaaggctttcttatcctcttcttgctattctttggaactctgcattcagatgcttatatctttccctttctcctttgctttttgcttctcttcttttcatagctatttgtagggcctcctcagacagcagtttacatcccaacaaaaagaagacacctgaagtcagccagctctgccttccctctagagctagggtgacatatcctgccttaccctggcctcctttaaatcttgaactattctctagtagacattattagtacgtggcccaaccctgcagccagctcacaccctaccccttgcctcttggcctatcagggtcccattttctgggaaatcagccttgcagcgaagccaccatctttcctgtgtaggggcagctagtggaaaagcttttaacagtcaggccaaggtcagtgagacttcccaaatgttgccccatgcctctctgtcagttttggtggaaaaatgattcagcccaggcacggtgagtgcagagggatgatgccccatggggcagagcaggagggtcagtgagcaagcctggagaccagactgctgactggccctgcctgtgaccctgatttgcagtgtccctttcagaggctttcaaatcacattaggctctggctgttgctgacatgatgagccatgtcagaatggccaagagctcttctgcttggcctcaccaggtggcccgagccccttgggagtcaacatttgcaggctccaggcactgcttggccccctttactgccccccaatgaccctacctgccttccccagctgcctttcctcctacatggtcccaggtattcctgctttgacaccttggactcagctaccagacacaagccagcccactgtgctctggcaggactggattttgtccagccagtggtctcaacccttgccctaccgtcagaatcacctgggaaactttaaaaaggatcagtacctggatcctactctaggccagttgaatcagaggctctgggaagggcctgtgattttcccttgaggagactgaggcctcgagcaggtgagtgacttcccgattttgcacatctagggagtggactggactccaggatcctgacgctcaaccctcggctccttggactgttactaatattgctgatgtctctacaagtatttttgaatccaagtttccttatctggggcttccctggtggctcagatggtaaagcgtctgcctgcaatgcaggagacctgggtttgatccctgggtcgggaagatgccctggagaaggaaatgggaacccactccagtactcttgcctgtaaaattccatggatggaggagcctggtaggctacagtccatggggtcacaaagaatcagacatgattgagcaactttcatttctttctttctttccttatctagaattctcagactgttaagacttttattcctagatattgtgattggggtttatgtgtttcttttcaggatttttttccccagaaacattttatttatttctctgtttttttagctttttgttttatactggtgtatagctgattaacagtgttttgatagtttcaggtggacagcaaagggactcagccacacatacacatgtgtccattctcccccaaaattccccttccatccaggctaccacataacattgagcagagttccctgtgctacatggtaggatctttgtaggatttttttttaagtttattaaaaattatgccttagtctgtgattaggatacatgggctactgcttagtaagtataaattgttttggaaaacctaaaacctttaaaatctgagagcttatagaaggaaacaagagtcactggtcaatcttttgtttaaaaaaaaaatattggggagatgtggcatgatatcttcttaacaaggacccttgtaaccttgtctaaatccagctctcttaccccctaaggttctagctgatggcattgtcagaaatgtcaacggattgaatgcaaggcatgacctaggtaaagcctcaccagctgccaagatgtggagctctcagtgaacaggcaggggaatgtcccattccaggatggaggcttccaggcctttaaggtggacccaactgctatgctcgtgggagaggaaaagtggaggagtgaagggtcaagagcacgggtggcccagagagtgagtgaggccggcctttcatgcagtgatcctcccactgatgacctcttcctggaggacaagagaaaaggaaccaaacagacagaagtgtttccttctcagctccctctggtaggctgaatacccatccccccaatgcatccatgtcctaatccccaggatctgttaattgtcccagctcatcgatatgaaagtcaaagttgctcagtcatgtccaattctttgtgaccccatggactatacagtccatggaattctccaggccagaatatccagatgggcccagtgcaaatacaaagccccttatcagagggagacaggagggtcagggtcagggaggatgaccatggatgcagaggtcagagtgacacagcctcataccaacaaatgctggtggcttcttaaagctggaaaaagcaaggaatggggtcctccctagaaatcccagagagcactggtcctgctgacaccttgactttagcccagtgagactgatttgggacttttgacctcaaggagagtagaagagttcctggcagtactcataattgtcatagagctattttttttttttcagttaaaaaattaatacttgaatacagtccacacttgaaagatagaaaagggcatataatgcaaagagactcactctcctatctcccgtctactggtttcttcccctctctaaaaggagctgcagttaactgcttccttgtggatacttccaggggactctacgtgcacgagcagtatgtacagaggcgcacgctctgtgcaaacagtagtgtattatccacagtattgagcactttctttttcacttcatattatcacggagctcgttctgtttctgaaagtacaggattgattcttgtttttaatggcagcattgatttcttttgtatggaggtgtcatcatttttacaacctgtcgtttagtgattgacatttgggttgtttccaatctccttccagttcaaacaatactactgtgaataacctactaatactgccttttgggcatgtgtaagatgcccatgggcttccctggtggcccagtggtaaagaatctgcctgccaatgcaggagacaagggttcaatctctgggttgggaagaacccctagaggaggaaatggctactcactctagtattcttgcctggaaaattccaaggacagaagagtctggtgggttacagtccatggggtcaaaaaaagagttaggaataacttagcaactaaacaacaagatacccatgggatagaatgtagaagagggatgactctgccaaaagtcagatgaactttcttacctagctagagactttattgccaaagtgcccatatcacagattgtactgattcacactcccagcagcaatgatggaaaatttgtccgtttcccattccccggcaatgcagtatgtcatctcgtctccttcagcttgacaggtgaaaacttggagatcttggtcagctctgcaaatgcagtctggagaagtactgagtcttggggtgagtcaccagtgtccaagcctggaaggccttctccctcatgtcctcggcagctgccccagcctcagccagggggcctctgaacccagaccagcaccgcctcttccccaggtggcccttagcaatactggaggagctggtatgagaagctggcttctccagctccttcttgaacagcatcctttatggctgcacatcagggaggaacttgcagctgagaaagaggagtccagggcatccggggacaggccagctgcagcaagaggcagcatggtcctgcaaccccgggaagttgaaagatgaaggcatgactgcattttcaggacacattaaagtcacgccttgtgattgctctgtgtttgacacttatcaggcctctctgagtaatctgaataacaactttttataaggggaagtcatccagctgctcaaacaaaaaacatacaggtcgccttgctgtttagcctctcctccctcactggacctgcctcgtgtccaggctccccgaagcgggttgatttcacgaggcgtataatcagcccacactcactctctggttaaaaggcattattaattttagattttctttctttcaaaagcttcttatttaccaaatagctcactacacgtatctatgacactaaaatcagtgtgggaggagggatggagtacagcctggggatgtgggtactgagacagagaactggatgaggagaaactggagtttggggtctaattgagtatttatttatttatttatttatgtttgggtatagcatgtggcttgcaggctgttagtttcctgaccaggggtcgaacctatgccccttgcagtggaagctgggagtcttaatcgctggactgccaggaaagtcctcttaccagatatttagtctctggaaaactaagtgagtctctcaatgcagccggggcttaaatcatggaatgtgggctatgctctttgtacatagtattctggtcatccttcttttccttctagtttatgctgttgcagcttgtgttgttatgaagtccatcgggagaaatatctggccagatggtcagcagcaagaataggaagctcgttagttttctaatcctccgtccagcttggatcctcccctgtgacacccatcatggtggcttgcctaggattgtcttcagagaacagctcagatttggtggagggagagctgagtttgcccatctctgtgcatgcgtatgttcagttgtgctggactttgtgaccccgtagactgtagtctgccagtctcctctatccctgggatatttcaggcaagagtactggaatgggttgccatttccttctccaggggatcttctcaacccagggatcaaacttgagtctgctgtgtctcctgcattcgcaggaggtggattctttaccattgagccacttactgctgctgctactgctaagttgcttcagtcgtgtccaactctgtgcaaccccatagacagcagcccaccaggctcccccgtccctgggatgctccaggcaagaacactggagtgggttgccatttccttctccaatgcatgaaagtgaaaagtgaaagggaagtcgctcagttgtatctgactcttagcgaccccatgaactgcagcccaccaggctcctccgtccatgggattttccaggcaagagtactggagtggggtgccattgccttctccaattgagccacctaggaaaccctgtatctgggcaccttgcaaatagaatcgtagggggatggtagccatctcccaaaacagaccccaccattagggatgatatgtgaggtgtcagttaaaaaacagagttgtcaagaagtgtagaaaactactcagttgaaaatgagagaaaacagagaggtgagattggggaagcagttgcaatttcttcctccttcatttctccagttgaaaatcctgccccttggttgacttgtgtgggctgttgaccggctggacaaagaaggaactgccatgtgaatttaaaagtcatcttaaaggaataacagtcactctacttttaatgtctccattaaaaatgagtgggtcatattgttggccttttccccagtgaccatgaaattgctctgatttataagagaaaacatctctgctccctagactttgttccgagtgagcaaagaaattaactttcaaggaccgactgtgttcatgctgtcatagtgtttcctgtgtggatgtgggggtgggcgcagggcatattaccagacgtcgatcctattcagcgggcagtgtcagcccaaagctctgcttaatgctgtgtcagaaatgcctaagagcatggcgtctcaaagacagtacagatgaacatatttacaacaccgaaacagactcgcagacagagaaagcagtcatatggtcatccaaggggaagggggataaattaggagtatgaggctaacatgaggtggttggatagcatcactggctcaatggacatgagtttgagcaaactctgggagatggtgaaggacagggaaggctggcatggcatgaggtcacaaagagacagacactacttagcaactaaacaacaacacggggttaataaatacatgccgtcatacataaaatagataaccaaaaggccctactatacagcaaaagggggctatggttaatatcttgtaataatctacaatggaaaggactctctctctctatatatatatatatatacacacatatatatgtatataactgaataactttgttgtacacctgaaactaatacaatattataaaccaactatactttaaaaatctgcaaggacatggtaaggcaatgcacaaaataaatacaaatggctaatgaagagagttcaccctctccagatatccaagtgtgcaaatcaaaacaacaccaaaattcttttttgtctcctaattgttcttgtcttcaagttgttgaagctgtttgacaagtaatgttcaatactgatgaggtgtaaggatagctataatagcgttaaaaataataataacataaacaccagggtctttactttgagctagtgctatttttttttttttttgcagataacaactcatttcattctcactgcagttctgtggggtggatagtgtttttattgacatagtgagcttgaagaaacagcttggaggggttttgtgacctgcctaagttcacacaggtaagaagagggggccagtgcctcccagtaaagcctttggagtcactcacctcttaactttggatctcgatgtcttcgactttgcagagaacttgtttggaaaagtatctctccgtcctagggctggagagacagcagaaggagaattggattaagagtcaaacattaatagcaccattcccacatctatggacttgggcacattatgcaacctctctgagttttgatttctctcctggaacaatgcggttgatgttactccaaagagaagtgagatcaaatgcaataatctaggcatgtgaaagccttttgctaacactagagtcctgggcaagatactaaagcagagactcagccgcctgctcttctggaactccattaattaagcaagaatgcctgtgtgtttgaggaagaaagatctcagagggtccatttagcctgtcaaaatcacaagattgagtaaactttggcaaattgtcctgaaaatgctttaacatacgctaagctctttgcaagagcattctcatccgtctctaggaacccatccaggtttaacatgctttgattctattttttcagagtttattattatctggaggattccatgaaaggcaagtaactctgaaagccacactgtatcaaatgaattttcctttaggtgagctgccttacagcaatagaatggctccttcgagacggtgaaccacagtgagtacttggcttgtaagcacctgcatttttgcctaagaatctgacaaccagctgtgccatttccaaccatttcaaacaaagggaatttgtccattgcttacctctgtctccactatgggcagggtggcctgatgaggagaagttcaagcacatggatccgcctctatagaacaaacacatgatggagttaaactttaggtaccacctacaaccaaaatttagagctgattgagatggaagtacatatttatactgagttgttaaaaaggacctagaaggtcaaagctcaagtacattaaaaagaatgaaataatgccattttgtagcaacacggatagatctagagattgtcatactgagtgaagttagagagggagaaatattgtatgacaccccttaatatggaatctaaaatgagatgatacaaaatgaatttatttccaaaacagaaacagactcatagagaatgaatttatggttgccggggatgggggaagataggggaaagtgatagttaggaagtttaggattgacatgtacacactgccatatttaaaatggataaccaacaaggacctactgtacagcacagagaactctgctcagtgggcagcctggatgtggggatttagggggagaatagatacatgtatttgtacggctgagtccttttgcagttcacctgaagctatcacaacattgttaagtggctataccccaatacaaaataacttaaaaaaaaagttcctatgaattggttgttcttagactttggagtaagggtcacagaactgtcgagaacttgataaaatgagaggaactcttgagaaaaaagcatgtccccatgtccacaaaaaagtttgtgtgcaacttcaggagactctagattaagaatctctgatggagaaggaggaagagagagagagttggagaataaaagaaacacactaaaatctcgacttatgttttctgcttgagcctcgaagttagtcctggacttcacagcacatccaggttggacagtagagttctcaggacccggtgccaaataaaaatgttggggagggggcgctcactcagaagttattggaactttgagacagtgatggcagaagatccttctgcacagggtacacacttgggagctggctctgggcccaggaggcaaagagggctcttcccgtctgttttggaaagcacagccttgtaacatgcaatctcctgcattaagaaatgcttggtgaacttgccagaaatttttgtcttagtttttattattcttttaaaatttctatttatttactttttggctgtgtggggtcttcgttggtgggtgctagcattctctagctgtggcgagcagggactactcttcgtagtaagggctactcttcattgtaggggctacttttcactgcgggcttctcactgtggtggcttcccttattgcagagcacgggtgccaggcacatggccttcagtggttgtggtgcatgggcttagctgccctgcagcctgtggaatcttcctggaccaaggatcgaacctgtgtcccctgcattggtaggtggattcttatccactgaaccaccagggaagtcctataattttcttttaaacttcaccttcatatttatggtggataaacaaacaaaaaacaattagaaacaacaacaaaacatccaacaaaagccagtctctttcccctcttaggtcaatgttagcaagagatgcagcagctccctctgcagaagacagctgtgggtgggctggcagaaaacatgctatctggcagtatgccaaaaaccctggccaggggctctactgggccagctgccctggggtatctgagaggcatcaccttcaaagtctgatgcttttgaagtgtgacccctttaacaggtttatatttatcagagtattacatatgcgtggtgtaaacaaatgaacatttcccaacgatgtctatgaaaaaaacagctgtcccttaacctcctaccctctatctttcacccttcttcccaggcctttcagctcttgagctatttcttgtggtttttaccaacacttttctagataagatgcctatctgcagtttctggatttatcagttttcatcattatccgctgacttctggaaatagacattggttatttgtagagtcccgacttttttggaacactccttgtattctgatcatttcctgtgctcccaggatagaagccttaaaaattgtgttctcagcctcccttacagctggggtgtagaaatgtaattgaggcttcatcagtcagatgcacctgccccagttttgattcagaagtgagtgcgtggggaaaggggcctgttggggaagaagccttctggcacctgtgctggtagaggctctggcttttgtgagtctctgatgcatggtccttggtgtcagtggtgtcacgggcaggttgcagcatggggaccgggcactggagacagtaaggcatccaccagtgcagcccatagtgagttaggcatcgttcctggagattctggaatgctgcctgatttgacaacctcattcccagctttatcaagtcagagtggagtctgctgcttgcaagtgggagccttgacttacgcactgagtggatgacactgtggctctgtcaccctgctctgtatctcccattacggtcccatcagcattttcggttaaattgttgttgctcagttgctaagttgtgtctgactctttgcaaccccgtggactgcagcacatcgggcttccttgtccttcactgtctcccagagtttgttcaaaatcatgtccactgaattggtgatgctatctaacagtctcatcctctgccagcctcttcttcttttgccttcaatcttttccaggatcagggtcttttccaatgattcagctctttgcatcaagtggccaaagtatttgagcttcagcttcagcatcagtccttccaatgaatagtcaaagttgatttcctttaggactgactggttgatctccctgcagtctaagggactctcaagagtcttctccagcaccacaagtctgaaagtatcagttctttgttgctcataattaggaccctataaatgttgcttattgctgagccaggttgcatattctgtgtaataggatgttaaaactgggacctccatttttttctctctcaatttaggctgaatctccaagatgacagatgctgctgattctcatattccaaagtgaggcctaaaactgcctgagcaggacttgcaatggagaatccaataactgaattctgtccgtaggtgaccacccagctctagcctataaagaaaggctgtaaaagacgaggggactgcagattggatgagtagttttggagagagctgtcacagtgctgaggatcgtaacaccaaaactctcccatccagacactaacatacccaggagggggtgtgagacacttcagcctagggaaaggggtttcagtgggtcccctcagaaccgatctgaatctctaagagctcaaggggacttagttggtggtgtctgagttactcctgaaaaatctaaaagttagacctgtggctatgatggtagagacaatagagatgggactgatattttagttgggtacagattgctaggttgaagtacatttttatatataattttaaagttaacactatctgttttctagcttccagagatgatattgagaagtaaggtgccatcctaagtttaccccttagtatgttatctgatcccccacttcagtctctaaaaactttaatatttttctctctctctggagtctgaaatttcatgagggcatgtattaagaactcaatgaggcttttcactttgggaaccaatttccttaagatttgaggaaaatatcctgcactgtgtttgtatttattattaagtctttattttattttttcttaaaagagctgtttaaggttcacagcaaaattgaggcaaatgtatagagatttcctgtgtacacccagccccccacatgtacaacctcctccattattgacattccccagaatggtacatttattacaggtgatgaacctacatcattgtcttctgaagtttaaagctgactttaaagctcactcttggtgttgaaattctgtgtgtcggacaaatgtataatgacatgtatccaccacgatggtctcataaagagtattttcactgccctgaaagttctttgtgtttcacctattaatccctctctttcccaacctatggcaaccactgaacattttactgtcttcatagttttgccttttccagaatgtcatatatttggaattgtatactatgcagccttttcagattggtttctgtcacttagtaaaatgcactttttaaaataatatttttcctctttattttctctattccttctttctggaactgttcttggtaggattttagacctccttgattgatcctctatgttttctctttttttaaataaaaatgtttgtttgtttatttatttggctgtgcctggtcttagttgtgccctgtgggatctagttccctgaccagggatccaacctgggccccctgcattggaagaacagagtcttagccactgaaccaccagggaagtcccaatattttatatttgtagtcttcttgtactactctctgagagagtttcttgatgttgttttccacctttattttgagagtattttaaaaactttctattacattaaaaaatttccaagaaaacagaatggaagttactcaaaaaaacaattaccctatgttccagaaatttaacttctagtatatactcaaaataactgaagcaaggtcttgttaagtatttgtgtgtccatgttcacagcagccttattcacaataaccaattgctgaaagcaacccaagggttcactgatggatacatgaataagcaagtggtagtataggcatcggagaaggcagtggcaccccactccagtactcttgcctggaaaatcccatggatggaggagcctggtaggctgcagtccatggggtcgctaagagtcggacacgactgagcgacttcactttcacttttcactttcatgcattggagaaggaaatggcaacccactccagtgttcttgcctggagaatcccagggatgggggagcctggtgggccgctgtctatggggtcgcacagagtcggacacgactgaagcgacttagcagcagtagcagtataggcatacagtggaatattactcagccttaaaaaggaaggaaattctgacccatgccacaacatggctgagccttgagaacatgataccaagtgaaagtaaccagttgccaaaaggcaaatgctatatgattccacttctaggagagaaccagagtagtcaaatttatagagacagaaagtagaatggtagttgctgaggaccggggacagaatggagaattattgtttaatgggaacagtaaataatgctgcagatacttcagttttgctaaacaaaaagagttctagacatagatggatggtggtagtagttgtccaacaatctgacttgatgccactgaacagtacacttagaaatggttaagatggtaaattctgtgttatgtgtgtttccacaaaaacattttctgagagcgcttctattctctgattgtttacaaagtgtcttgtgcttgtgtcatgagttaaaaatcttatctttctcaggaatgttcttcttctcctgttgaagtatttgtgtgtgcgtgtgtgtgtgtgtgtgtgtgtgtgtttaaatacctttttctgtttctaatagtatctctagaactcagggtttctttatatctagtttgtttgttttggtatttgtctttgatgttgagactgtttctcaaaccccaggcaatactcagctttctcttcatatctgactgatgaaatgaagagttgagtggaggtcatctgtgtggggagggactctatgatgggcagtttcgctgtagagtcagaggatactagggcagcctctttaattgggaatctcaaaacatccatctctggaggtcttaattctggggctctttcttcagaatctcaagagcaaagtttaactgccttccagggttttgagaatgagtaggagaagtgtacaagaattccaccactttgtaaatagtcttctgattggttccatatttttcaaccccatttctccatttcgctcttggttccttcccaacttagttccctcagttgagactctctttggttcagtttctttagagaacaaacttcccacctcaggtctaggaggcaaggatgggaaaaaaacgaagattcagttatcttgtgtacacttttaaacagtccttctctttcagccttgagacctgctcttacttcctgtgtacttggtatcttcatttcctgggcttttccacagttccgtgggatggggactggcttacttctctctttcttccgctgagatttctttagttctactggtcacttaccacctctctatctacttggtaatctacctgggctcctgcactgctattttcatccttgtggtcttacaataaaaaatttcctctgctgtcatttttatagagttagaggaggaagaggagaaaaacaggtgaggctcatctgtttaaataggagtcacaactgttgacttaagaaaaaggtccataccatgagagaaatgtcatgcttactctgactcatcaacttgggttcctcacaccccatttcacagaaactgggcaccttcattcaaatcctgggtcacacttacagaataagccattcatttgaatgaccaacagatcatgtggcatctgcaatgacagatcctgctgagttaggagtctgccctgaagttttgtcctgcttaattagctttccttctctttatcctcagtccaaaacttctgtatgtagtaaaatgttttctaggctatggctggctatatacacataaattttttgcttacattgttaatatgtcagcatcattggaggcaacattttgtggcagaaaccattagttttctagccagcatctgtcctctacatttttatcaacagaacaccaattttgtttagggcagtagctccatctcccagtcttctttacaggtaagaaagttctgatcaatgagatgaataggacttctgggaaagctattttaaatggaattcattcaggtggaagcctttgcccttcccctgattcttccaagaccatgcgcagggggctgaggctggagcagatgtcttactgccgttaatcaaccaacatgagggtccaagccacacaattaagacagctgatggcactgtggaagctatcaggttagatatgattggcttgcaagtgaaacaagccaaagttagtcactcagtcatgtctgactctttgcaactccatggactgtagcctgccaggctcctctgtccaggggattctcctggcaagaatactggagtgggctgccatgctctcctccaggggatcttcctgacgcaggaatcaaaaccaagtcttctgcattgcaggaggattctttaccatttgagcccccagagaagcctctgaatttcttgttctatgagaagataaaacctttatatatatttaaatcacttctgagtcatgtttccagttacttggaactgaatgcagcccacaatgacacagattccctccctatctttaaataccttttgctgtgagtctcagtgctcagttatgtgttcggaggagagtaaggtctctgttgaccagatgttgctggtgccctgaaaatcgcttctccgtgctcaccatttctcggaagctccagcctggtttccatctggccagcacctgtgactctgcctgagggcttcctccagccactagggcctgctctgcttacacacggggcaggctggaaagatattccgggaattaatgttcctctcctcttcacatccaagagcagccttcccccagtgcctgaaggggtcggtgtatcaatactctggctccggggctttcctggtggctcagcggtccagaatccacctgccaatgcaggagaaatgggttctatccctgatcggggaagatcttacatgccgaagagcagctaagcccatgcaccacaactactgagcctgtgctctagagcccgtgttccacaatgagaagctcccgtagtgagaatcttgcacaccacaactagaaaggagcccctcctcaccctaactagagaaagagcccgtgcagcaacgaagacccagaacagccaaaaacagataaataaatgaaaaaataaaatacactagctcccttgcttctctggcagataactgtgaggtgggtctacattaactgccagggctcccctaggatcctggggggcaagatcaagctacacttgcctgcagttgccactgacttgtagcacataatttagcagcttccttccgttttctgtctcatgcccccactctcctaccagaattttctgggatcaccttccaaagaaactacccagactagaatctcagtctcagggtctgctcctgggggaacccaaaccaagataatggaatttttacccagcgttgctttgaggtcatggaagctaactggggcccagaagtttttatatgcccctttgcatgtacctatgcttccctggtggctcagagggtaaagcgtctgcctgcaacacaggagacgcgggttcaatccctgggtcgggaagatcccctggagaagggaatggcaacccgttccagtagtcttgcctggaaaatcccatgaactgagaagtctggtaggctacagtccatggggtcgcaaagagtcggacacgactgagcaacttcactttgcatgtacccagctagtctatgctgtgaaattcaggcagtggttcctgctagggcagcactatggggcctctggctggcaaccttttttggtgattctttccctcctccacaactctctgtgatcccaatgccccatgttgccctgagaaagaagcatcagtgtgaggcctgggttggtggatattctgagctggttattgtgggcagccgaggggactggccacaaaatgccaaagttaggagaggacgtcaaccctagctctgtagtttacaggtgaacaaaaatgctctcaatctccggtgagctgggcaagattcttcctaggtggccaacttcttccttctctggttctcctacaaaatgaggctcatctcagaagagaatgtgtgttccaagtaacctgtgctgtgacctgagtttgcagtattcagaataaggagcctacttgaggaacatgattagatcacaggtccttcttttttttcccctccccaaagttctgatttaaagtattctgcctccggtgggagggaggctcaagagggaggggacatatcatatttatagtggattcatgatgttgtacagcaaaaactaacccaacactgtgaagcaattaccctccaaaaaaataaagtattctgccccactgacagagatggatgggttcagaaattagtgagacccaaagttttggcatcagacgcaatcaaacccacagctgatctagaataatccacactgtatgaagacaaacttgttcccttagaccaagtctcagcaaactactgcccataagccaaactgggctcagagcctactgtaagtaaagtttcactggacacagccacacccatttgtttacatgatggctatggcttcagtactacgtggatctaggggactagttgtgacagaggtgacgtgaactgcaaagcctatatgtttactgtctggaccttacagaaaagtgtgccaatccctgcaccaggcggcctccagtctcccacttgaaactgccccatcaaggggcacacctgccatacctccttctatttattttaaatgtaattttaattaattaacttattttttttcttttaatttatttaaataccaaaagcattttgtattggggttaaccatgttgtgatggtttcaggtggacagtgaagggactcagctgtacatatacatgtatccattctcccctaaaacccctcccatccggactggcacagagcattgagcagagttccctgttttacacaatcggtctttgttggtcatccattttaaatataacagtgtgtacgcgaccttcccaaagtccttaaccatccctccccaccgcccctgtctccccctcaaccatgagttcgtgttctaagcctgtgaatctctttctgctttgcaagttcattcgtgccatttctttttggattccaggtgtaagggatgtcatatgatagtcgctatttggctgtgcttggtcttcctcgtggtgtgagggctctttgttcctgcgtgtgagcttccttagttgcacaggcttagttgccccaaggcacatgggatcttagttccctgactggggatcaaaccggcatcctctgtacagtagggcagagtcttaaccactgggcggccagggaggtcccaggcaacacctccttctgccttaacctccccacggctccccatcacacctcaattcctggaatagtgcttctgaaactttaatggcaatcagttattggaaatacaggctctgattcagtaattctaggatctcactagactgtgtttctaactagttctgggggtatgctactgtggcttctctgagaaccaacctttgaggagtaagattctagaagactgggtttgtctcagcagaaccagcaactttatcactgtttctcacggtttggcattgctaggcaataccagcccctctctcaccctatcccttccatcacacacacacacacacccttattacaggaatatggcatcactgtctcccctttcccatgaactctggttttcagtccgagtagccgttttaagagttaaagagctgtgaggatgacagaaggagagatgccagaactctaatgagtctctctttttatatttagtttgctattagataatgctcgacacctgttctctagacagctctgtttttaatctcttcgatttcactttcttggccacgtggccacacagacatgttgcaccgcatgagtaatgcaacgagagccaaacaaaatagctgtttctttggaatcagaagcacgaccagggactaaaaacagccgaggctgggtttgggcccacggtgaggtgccggtggagaaaacagctctgcgcctggggttgggcccccaacacttggctctgggtggctttcctttccagacttgaagctccagggagtctggcacgcgtgtcccaccctcaggatgaaaagaggaaagatgactaggaaactctcttctgctgtgctttaattggagagcaggcagacgagttttccagaagtcatttgaatatttctaattttgatcgaattatttcatttgtgtgaagttgcccaaaacatgcagtttcagcctgagatcttttcccagaagctaccagagaaacaggaatagtgaacccattgagaaacctttctcctgggatccctaggctttattatctgtttggctgtggctgcagctgactgacagatgtgtagatttaagtcatgctacaactgtaggtgggctgttgttgttcagttgctcagtcgtgtccgattctttgtgaccccatggactgcaccacgccaggcttcctgtccatcaccaactcccagagcttgctcaaactcatgtccattgagtcggtgatgccatcccaccatctcatcctctgtcacccccttctcctcctgccctcagtgtttcccaacatcagggtcttttccagtgagtcggttcttcacatcaggtggccagagtattggagcttcagcttcagcatcagtctctccaatgaatattcaggactgatttcctttagggttgactcattcaatctccttgctgtccaaggactgcaacacctgtagatgggcagcccacgcctaaatatcaaccattcaagggtgggggtaattgggagcaaaagctcagagatctagctatgaggacagatttgacagtgtgacataaggaaccaccacagggtcacatctttcttgaaataatgaggactgatattgagaagagtgtgcttggcctagaggctgtcttctttctgaacactatcctgagcccaaccttctccaaagtctaatatgactagaagcttgtcctgggtattaacagaaaactgtagtgagttgtttttttttaagactgtcatttagcatatatccttaaattaggactttcctgttttaatgttcctgaaacatgtggcaacttatttttcactcacaaaatgaaaatgcagtcttgagcgactgagtcagagtttataatattagattttactttttattatagttgacttacaatgttgtgttagtttctggcatatagcaaaatgattcagttatacgttcacacacatatgtttatatatatatatatgtattcttttttatattcttttccattatagtttattacaggatattgaatatacttcccagttttatacagcaaaacattgttgtttttctattttatatgtaatatagtatagtttgtatctgttaatgtcagactcctaatttatcaagggttgattttattttaattttttggtgttacattttgagcggaggcaaacccacaccgaaatgctcccgggagtggtcacatttgagggcacagatctgtgtggtcaaaaatgggaccactgagctgcaaggtgcaacctagatagcatattgaaaagcagagacattactttgccaacaaaggtccgtctagtcaaggctatggtttttccagtggtcatgtatggatgtgagagttggactgtgaagaaggcggagtgccgaagaattgatgcttttgaactgtggtgttggagaagactcttgagagtcccttggactgcaaggagacccaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggccgacagaggatgagatggctggatggcatcactgactcgatggacgtgagtctgagtgaactccgggagttggtggtggacagggaggcctggcatgctgcgattcatggggtcgcaaagagtcggacacaactgagtgactgaactgaactgagctgcaaggagctgtagaaacacagcaggtgatgagcccatgccttgccttctgaatgtagacttgttaccaataggtagactcagcatctttgctgttggcatggcaaccagaacaggagggctggatcctgagttggctccaggtaagggcactggatgatgccgagtaccctggtgcctggcccttcagccccagccatgctcccacccttgggctgtgctgggaacacagacgacaggagcccatccgaggacctcagcaggaaaccccccacaggctctctcggtccctgggccttctcttcagggtccctgagcctttagccctgactctgcactccagctggaggcccctgctctgggccttctttttcccctcacctgggctaccagccttgactctccagacaaaacacccagccacagagtcagcaaccaggtgatgaaagaagtggagatgcgtctagaatcaggctgtcctccagtacttctgactgaatactgttttccaggactgtgtataaagggcttgcaacttaaccccagaagcactaggtatgttattctccgccgtggggtcagtatttgccacatagtaaacttatactagtccatgccatagggggagctcagttactctttttttttttttttaaataactttatttagatttatttttggctgtgctggatcttcattgctgtgtgggtttttctctagtagcagataggagggctgctctctagttgacatgtgcgagcttctcattgcagtcccttctgttgttgcagagcacaggctccagggaggtcgggcttcactacctgcgttctgccatctccagagtgtgggctcagtagttgtggcacggggtctcagttgctctgagacatgtgggatcttcccagactagaaatcgaacccatgtttccagcattggtaaggtggattctttatcactgagccaccagggaaggagttttggcatttgaaggtttggggacttccctggtggctcagatggtaaagaatccacttgcaatgcaggagacctgagttcagtccctgggttgggaagatcccctggaggagggcttggcaatccaatcctgggttgcctggagagtccccatggatagaagagcctggtgggcctcaatccatggggtcgcaaagagttggacacgaccgagtgattaaacacacacaaccagggaagccccaagttcagttattcgagtctattaaaaaaatcacactgccctggggttatgctattataaaggataggcctctgtctcaggaagtggaaactataggctgtttgtgtctttgtacatcacatctcacacaaacacaacgtttgtagagtggactataggcctagatggtgtattggtcagggttctccagagaaacagaatcaatggaattatatagagatttattataaggaatgggcttcctaggtgtctcagtgggtaaagaatctgcctgcaatgcagggtacctgggttcggtccatgagtggggaacatcccctggagaagggaatagttaagcactccagtattcttcctggagaatcccatggacagaggagcttggtgggctacagtccacggggtcgcaaagagtcagacacaactgaagtgactgagcacacacgaattatgaggaattggcttgtgtgattatggaggctgaggagtgctgaggtctgcagtcggcaagctggaggctcaggagagccgagggtatggacctggtcctcatctgagcatgaaggcagtggagtgatgtcccagcttggagacagccaggcagagaaagggggctcccttgtgctgttcttagtctctcagttgtgtctgactctttgtgattccacagatggtagcccataaggctccaccatccatgggattctccaggcaagaatactagagtgggttgccatttcctcctccaggggatcttcctgaccaagggatcgaacctgcatctcctgtgtctcttggcactgcaaggggattctttacctgctgagccatcagggaagctccttagccatagatgtacatatgtcccctccctccctcttgaaccttccttccaccccacaatctttcccaaccctctaggttgttacagagcccctgtttgagttccctgagtcatccgcaaatttcctatatgcccacaatatcctctgtgtactttgtggatcctccttgagaattttgccaggaaagagagaggatgctgattgctctggtttgggttaactattcaaccctaaaaaactcacatccctgaaaaagtcacctccctgaaaaagtccacagggacaggaccagtttgggtcaccaacctgtccctgtgatggggaaagtagcattcctacatcagggcatggaatctgctggaatccacagaactacaaattcagggggtcagtgacactgatctgagaccttctggttttactttgtgtgtcagtcactcagccatgttcgattctttgcgaccctgtggactgtagcccaccaggttcctctgtccgtgggattctccaggcaagaacactggagtgggttgccatttccttctccaggggatcttccccacccagggatcagacccaggtcttctgtattgcaggtggattttttactgtttgagacaccagggaagcccagttttacctaaatgttgtctaactgaaacataggccagtagcattaacagtgcctccagccttgaaaccagtggacattccagatctattttgtatcatctaacagttaaagcagacatctcagaatatcatgtgtttatccaaaagggttgtaattatagtctcaacccagactttgttagttaatgcattaataaagaatagatataaatatatcacgggctaaaatctttttgacagctatctttcaatataattggttccttttgtaacctcatgtgtcttactttataaatttaaaaacttctttccaaggctgggtttgaaggcaacccagggattgaagccaggtctcccacattgcagacggattctttaccagctgagccaccagagaagcccaagaatactggagtgggtaacctatcccttctcctgggaatcttcccaactcaggaatcgaaccaaggtttcctgcatttagatggattctttcccagctgagctcccagggaagccccatccacaggtttcaccagccagtcaaaggggtccctgccagcgactgactgattcgcgtggtggagaggggatatggtcttgcctacacagcagcctcaggcacacaggacacaggagctgatgcctctgctcctgctggctggatgtaagcgtttgtgccttgatttgtacctaactgtccttattgctgaagtttttgctgaagtgtgtgctcagtcgtgtctgactctttgcaatcctgtggactgtggcccactaggctcccctgtccatggggttcttcaggcaagaatactagagtgggttgccatttcctactctgggagcttttcctgacccctggattgaacccatgtcccttccatctcctgcattggcaggcagattctttaccactgcgccaaaactatccttacagggaaactgtaaccaagcaggatcctatggggccttcctgggacacacactttcatgtcctccccttgcctcttgtgtgtagaaaaacttcagccaaagaacaaatttaatcagagaagtgagaaaatgcagaagcaaaatagaatagtcaagcaagacaaaataataatagttttgccattaaacaaaattaaggacatttaattcctcctccaggggctagaaataatatcctgagacatatccattgtttctcagttactgaaacccattcatgaaacttaacatcatgaagaagttaactacatgttgaccagcctgtagccatgacatgagatgctctatcatgcacaactctaagtattggtctcaagaaaatgggaataaaccaaacctggaattgtagactaactgtgcttaaaatgggcttcccaggagactcagtggtaaagaatctgcaggtgactccggttcagtcgctgggttgggcagatcccctggagtaggaaatggcaacctgctccagtattcttgcctggaaaattccatggacaaaagagcctggagggtcatagtccatggggttgcagagtcagacacaactgagcacgcatgcccatgcttaacacagtcaagacgacactgatcagaccgctgcgtggccaatttcatgacgactgtctgggctgactgtgctcttctgcatgcagtcctctccctcctcttgtgcctcctctttaaaagctcttgacccctgatctgcaactggggttcagtttttggacttgagtctgacttcttcccaggttgctggcctcctgaataaagcaactttcttttcctaccaacacttatctctcaagtctgggcttttgagtggcggaacagccaaacctgagttcgatagcaaacccattttgcatccacctcctgacaaagcacagatctcaatggttgttgaatgaatgtgtcctgcttcccccaaactctgggtgtgggcagatgaatccagggctttcagtgtattgggggaagcaacaaagcatgaagggcagggctgagggcctctgacctgctccctctttacctcatggtagaaaatagaagcttgcagaattcaagtgactcaagattgcagttggtattccttggtcatttctgatgtacaaatgtctttcgaccttttcttccctgaaaggtttcctccattcctttcttctggccccacagagggatttactaaggcaatgattgttttcccatttcctgcacaggtacagggatgtgcatgaaaaagtacagctgtgaaccctccaaagtctggagagttgaaagacaccatgtccacttcactgtgggtgacggaggtccccccttcaccgcagccctgctgttgcagaacggtggttcccagctggggcagttttgcctgccaggggacactggacaatgcctggagacatttttggatgtcacaactggcctctagagcgcagaggcagggatgtcgttaaacaacacacaatgcacaggacagccccacaacaatgaattctcaggacaactaactgaaatatcagtacaaccaacaattgagaaaccatttcagaacggtcaccaaatctttcctggccatttgaagaggcatctactaaagcatcggaaaaattaaataaaaccaaagtagggacaaacttgttgtcttgagaaaaagaatagtttagcagattacagtggaaggcagtggtcctcttaaagaaactacatttcttggagaaagagagtggcattcagggtaaaaaggaagcagagaccttatcttccttcctgtgacttactctcttgaagtcatttatgcaattccagagctcctatggttcaccttgactgggtatcctctatctagtcatctatctatctttattattgggcttccctggtagctcagctggtaaagaatccacctgccatacaggagaccctggctcaatccctgggttggaaagatcccctggagaagggaacggctacccactccagtattctggcctggagaattccatggactgtatagtccatggggtcgcaaagagttggacatgactgagcaactttcactttcgtctttactattattattttatatacccattgggcttcccaggtggcatagtagtaaggaatctgcctgccaatgcagaaaacttaagagactggggttcaatctctatatcagaaagatcccctggaggagggcatggcaacccactctggtattcttgcccagaaaatcccatggacagaggagcctggcaggctactgccatagagtcacatagagttgggcacaactgaaatagcttagcatgcacacatcatttgccagctagctattgtgtcaagaacaaattgctccaactttggtaaaatggaatgacatcatttccctttgggcccaaacacaggagttcctatttctgttgctgctgctgggatctggctatggatttctgattctaatctgcagtggctgaaaggacccactaatgcagacctttgcctgtgaactcttcaagacttgggagacctttctccctactgttaaggatggaacagcccatgaagccccacgtcctgtccactcatatcctctcccatactgagctgactgcccctaggggtactcccaggccagaggagggatcctttcaactcatgtcacattaaaacaaaacaaaactaacatctgagacagattctgggcgaagaactttggctgttttctctcatgtttcatcattgtgaaaggaaaggcttgccctgttgcttctcccatgtgcccacgggcggcctttgatgttgatttcatctgatgtaatcaggtagacaaatgacgggggcggggccacctataagcaggacgctgttgtctgccctgtggctcctcatagtgggggagacctccagctgctcaggtgggttgacgggtgactgatcctcccttcccaggtactgccctgacagtgggtgtttcagcttgcatgtttcaacttgtgtgtgtggatgaaaggaggaaggaggagtttgaagaaggactgatgctgaagctcaaactccactactttggccacctgatgtgaacaactgactcctttgaaaagaccctggaaaggtctgctgggaaatattgaaggcaggaggagaaggggacgacagaggtggactgggtggactccaagagttggtaatggacagggggcctggcatgtcacggttttacggggtcgcaaagagtaggacatgactgagcgactgaactgaactgaactgagcaggggacggaggggagatgggagcatgaaggtgaaggcctaccacgccccccactcggcactactggataatttaaggcctcttagagggtggggcttcgagaaggaaatggccacccacttcagtattcttgcctggagaattccatggacccaggagccaggtgggctatggtccatagggtggcaaagaggtgaactccactgaagcaacagcatgcatgcgtgcatgctgcagaaagtggggctaggccgagagaggcgaatccaggagagaccacacgagactgtagcacatccggatgacagagctggtggggaggagctagtctctttccttcccccatcactccagtggcttcaagccctgggggttcagggcctcccagctgaattagccaagctctggacttgaggagggggcagatgtgaaggaggcccagtacagagaccagagggagatctgagtgggattactcttgtgcagaagtgaaacacccccagggagatcctaggacaaggttggggtgagggctgctgtcctgcagtcaggtggaggatttggtatgagaatcactatgactacgtatgcactcagactgatgactgccactggggacatgaaggtgtgcaatggctcatcctgtcctggggctgacccataggaccagtgatcggggtgtagtatatgggtataggagtcaacagagcccagaaagcagaatacaaagtagattcaattaataccattgtcttagtctgttcacgctgctagaacaaactaccatagaccatgtatgttagtcgctcagtcgtgtccagctctttgtgactccacggactgtagcccaccgggctcctctgtccgtgggattctccaggcaagaatactggagtgggctgccgtcccttctccagggaccatagactgggtggcttataaatgacagaattctatttctcacaattctctaggctgggaagtccaagatcaatgtgctggaagatttggtgtctggtgagagcttcccggtccaaaggcagctgacttctcactatgtcctcacatggtggaagcagtgatggagctcctggggtctctattataagggcactaatcccatcataaggatcccaccctcaagccttaatcacctcccaaaggcttcactttttaatactatcacaaaggggttaggatttaacacccaatggacattcaatccacaacaagcatgactgaaggtgtcacttccttctgaagggtttcattttgctctggcccccaaacgtttgaaacctccttactttgaggaagcccatttgtaaaagcatggcatgaattttatgctgaaaactggagatggatttggggctgcaggaatttctgcacctttggagacaaaagacaatgtggggcacctccagttgatttgaactttggactataagcaccctttcatttatttatttgtttattgaatgtttatgtgtcatgcacctattatagattaaatctggggaagcagacctgaccacagtatagttcctaccttcaaacggcacagagcccggtgggctaaacggatgcctatggctgagcttggattgtaaatccaacatataacatgccttgctctttctttctacacttctgtattttcagggaaacctgtgttccttgcagatggggacacattcagtgtatctctatgtccatgttgctgcaaatagcaccatatcattttttatgtaaatggccttatttctatgtcctcagaacacacattatggggacacatagtggacactctatacgtgtgtgggattcagttgaggcagaaactctgcatgtgggtcctttcttacagttttatttattttcacttttggctgcactggtctttgctgctgtgctcgggctttctccagctgcagtgagtgggagctgctctctagttgttgcttgcaggctcaggagttgtggtgcatgggtttagttgccccatggcatgtgggatctccccggaccagggatcaaacttatgtcccctgcactggcaggtggattcttatccactgagccaccagggaagccctgcatatgggttctgaaaagaggcagtaaatcaagaggtgaatttcccccactcctctggttctaggaggatcaactgtcttcatggagttgaacctcaaactcaagttcagttcagttcagtcactcagttgtgtctgactctttgtgaccccatgaaccgtagcacgccaggcctccctgtccatcaccaactcctggagttcactcagactcacgtccatcgagtcagtgatgccattcagccatctcatcctctgtcgcccccttctcctcctgccctcagtctttcccagcatgagggtcttttccaatgagtcagctcttcacatcaggtggccaaagtattggagtttcagcttcagcatcagtccttccaatgaacacttgggactgatttcaagaccacctgctaaaacctcccattttctgcagatcttagtgctgagtcacctacaaccagccgctgccctatcccttgaatcagcttcaaaacatgacactggcagaaggcaaactttccaagttcaggccccaggaaaataaaaagaagtaaataagactgcaatgccagatggtctgaaaggacagagctggcgtggaggattaactggctggttataaaagctgtcattacagagtgtcatcgttggtgggttatttattagctctcccctttaaataccaaatgtcaaatgtgttaatgtgtagaaaccaagccttcccctcccagctgctccggtgtcaggctgccagctgtattgtctcctttgcaggtcctgccaggagttcagcattcatatggcacgttatgcataccatattgcacttaagaaaggccagatgaggccaactgggcctcataatcagcctgtcaatcactgcactgcgttgtccgtgtgactgggtgcacaaacctttgttctcggttagaatgggctctctttgagccccgtgcaccagacaggaacgtatggtttatttcaccaaccattgcctggaatcagaggtgtatctatcaactcagtgcttatgaaggcttagggaattgcaaaatgcctgttatgagaactattttgcccatgtgaatggtacttcatttaaccactgccctcaggcaatctctgtgtctttctctcttctatctccctcttgttgtttttttttcaattagtattagcaattttttcattgaaatacaattgctttgcaatgttgtgttagtttctgctgtacaatgaagtaaatcagtcatgtgcatacatatatcccctccttctagggcctccctctcagcccacccccatcccacccatctaggtcatcacagagcactgggctaaacttcctgtgcattccggttcttgcgaactatctgctttacacatggtagtgtatatatctcaatcccagcctcccaatttgtcccatcttccccttccctccccaccgtgaccacatgtccattctctactgtcttggaaataggttcatccataacattttccaccattatcttcattacctccaccatagtttggtctcaggtcaaacaacagggagggaacacagccccactcatcaacagaaaattggattaaagatttactgagcatgcccctgcccatcagaacaagacccagattccccttcagtcagtctctcccatcaggaagctataagtctcttatctttattctcagagggcagacagaatgaaaaccacaatcacagaaaacaaatcaaaccgatcatatggaccacagccttgtctaactcagtgaaactacgaaccatgccgtgtagggccacccaagatggatgggtcatggtggagagttctgacaaaacagggtccactggagaagggaatggcaaaccacttcaggattcttgccttgagaaccccatgaacagtacgaaaaggcaaaaagataggacactgaaagatgaactcccaggtcagtaggtgcccaatatgctactgaaaaagagtggagaaaaaacttcagaaagaatgaagagatagaaccaaagtgaaaacaatgcccagttgtagatatgactagtaatggaagtgaagtccgatgctataaagaacaatatcacgtaggaacctggaatgttaggtccatgaatcaaggtaaatcggaagtggccaaacaggagatggcaagagtgaacattgacattctaggaatcagcgaactaagatggactggaatgggtgaatttaactcagatgaccattatatctactaccaggggcaagaatcccttagaagaaatggagtagccatcatagtcaacaaaagagtctgaaaagcagttcttgggtgcagtctcaacaatgaaaatgatctctgtttgtttccaagggaaatcattcaatatcacagtaatccaagtttatgccccaacaggtaatgctgaagaagctgaagctgaacagttctatgaagacgtacaagaccttctagaactaacacccaaaaaagatgtccttttcattataggggactggaatacgaaagtaggaagtcaagagatacctggagtaacaggcaaatttggccttggagtacaaaatgaagcggggaaaaggctaacagagttttgccaagagaatgcactggtcatagcaaatgccctcttccaacaacacaagagaagactctacatgtggacatcaccagatggccaacactgaaatcaaattgattatattctttgcagccaaagatggagaagctctatacagtcagcaaaaaaaagaccaggagctgactgtggctcagatcatgaactcctaattgccaaattcagacttaaattgaagaaagtgcagaaaaccactagagcattcaggaatgacctaaatcaaatcccttatgattttacagtagaagtgacaaatagattcaaggggttagatctgataaacagaatgcctgaagaactatggacagaggttcatgtcattgtacaggaggcagtgatcaagaccatctccaagaaaaagaaatgcaaaaaggcaaaatggttgtctgaggaggccttacaaatagctgagaaaagaagaggagaaaaaggcaaagaagaaaaggaaagatatacccatttgagtgcagagttccaaagaatagcaaggagagataagaaagccttcctcagtaatcaactcaaagaaatagaggaaaacaatagaatggaaaagactagagatcccttcaagaaaattagagataccaaaggaacatttcaagcaaagatgggctcaataaaggaccgaaatggtatggacctgacagaaacagaagatattaagaagaggtggcaagaatacacagaagaactatacaaaaaagatcttcacaattcagattatcacgatggtgtgatcactcacctagagccagacatcttggaatgtgaagtcaagtgggtcttaggaagcatcaccacaaacaaagctagtggaggtgatggaattccaactgagctgtttcaaaccctaaaagatcatgctgtgaaagtgctccgcttaatatgccagcaaatttggaaaactcagcagtggccgcaggactggaaagggtcagttttcattccaatcccaaagaaagacaatgccaaagaatgttcaaaatactgaacaattgcactcatctcacatggtagcaaatgctcaaaattctccaagtcaggtttcaacagtatgtgaaacgtgaacttcctgatgttcaagctggttttaggaaagccagaggaaccagagatcaaattgtcaacatctgttggatcatcgaaaaaacaagagttccagaaaaacatctacctgctttattgattatgccaaagcctttgactgtatagatcacaacaaaactgtggaaaattcttcaagagatgggaataccagaccacctgacctgcctcctgagaagtctgtatgcaggtcaggaagtaacagttgaaaccagacatggagcaacagactggttccaaactgggaaaggagtacgtcaaggctgtatgttgtcaccctacttatttaacttatatgcagagtaatcatgcaaaatgctggactggatgaagcacaagctggaatccagattgccaggagaaatatcaataacctcagatacacagatgacaccacccttacggcagaaagcgcagaagaactaaaaagcctcttgatgaaagtgaaagaggagagtgaaaaagttggcttaaagctcaacattcaaaaaacaaagatcatggcatctggtcccatcacttcatggcaaataaatgggaaaacagtgtaaactgtgagatactttatttttgggggctccaaaatcactgcagatggtgactgcagccataaaattaaaagacacttactccttgaaagaaaagctatgaccaacctagacagcatactaaaaagcagagacactgctttgccaacaaaagtccatctagtcaaagctatggtttttccagtggtcatgcatggatgtgagagttggactataaagaaaactgagtgtcaaagaaatgatgcttttgaactgtggtgttggagaagactcttgagagtcccttggactgcaaggagatcaaaccagtaattccaaaaggaaatcactcctgaatattcattggaaggactgatgctgaagttgaaactcccctactttgaccacctgatgcaaagagctgactcattggaataaaccctgatgctgggaaaggaggaggaggagacgtcagaggatgaggtggttgtatggcatcactgaccagatgaacatgagtttgagcaagctctgggagttggtgatggacagggaagcctagtgtgctacagtccatggggtcacaaagagtcagacatgactgattgaactgaactgactgtaccatttttctagattctacatatttatgaaaatgtacaatatttgttttttttctgatttacctcactcattatgacagactgtaggtcttttcacatctctagaaatgactattttgttccttttagtggctggggaatattccattgtatatatgtaccacatcatctttccccctcttttgtataaaacttaacctcaagtaaccaactactgatgctgggaaagactgaaggcaagaggagaaggggatgacagatgatgagatggttggatggcatcagcaactggatggaatcaccgactggatggacatgagtttgatccaggtccaggagttagtgatggacatggaagctggtgtgttgcagtccatgcagtcacaaagagacatgactgactgactgaacaacaacagttcatatgttgctcattattcaagataaaattatttgggacagaatggactgtgtggtcagagggtctctgaaagttgtatgagttatggtgactgttgccccatctttgggagtggagttgctgtctgaggccacagggtgtcagaagttaaaagaacggtgccagacttctctgcttgtccagtggttaggactctgagcttcccaatcaaggggatgatggcacaggtttgacccctggtcggagaagtaaggtcccacatgcctcacctttattactgaaaaatctgctattggaggatgttggtagccagcaagcccaatctgtgatgagggataagtcgccatattgaattttatgtacattgacttggaagcaaaagggggaaatccaaatggtcctatggactgggatggtgtgggtgggaaatgtgtcagtctgagggggaggcaggtaacagaagtgggtgggagggtatcagatgccacagaagtcaggtcagatgaggacagattggaaaccaatatgcagtaactggaatgtcactggtgaccttttcacaatcaacatgaggagagagattgagaaaagatttctaatgttctatttctaaagaggaacttgtggaacccagatctggttttttatactcaatcaggtggcacaattctgagtaagaagatggcatttggacttcttatttgtcatttcctccttcatccattcaatatggaaatgaaattccagtttttaggcttcccctgatgatgtgtttgaaaattcttgtcttgtcatccagggagaaggagtgaaaacaagcaaatcatgtctggagggcagtatcagatcaacagcgtttcttgacccaagatgataagctggtgggattccatgccttctcatgtggccgttataattctgggggcttcctcaggtggctgttttgacatagccattgtgatgggagtaacgaagagagtgagattcagaaatgaaaatagacaggggtttcagagatcaagttggaagtgccagatacaaaaaccttgaaggaatatgtttaagtaaccttaaacatagcccttgaaggatgttgtatttattagtcagtgttcttcagagaatgtgtatagatattagaggaggttttttttgggattggctcacatggctagggaggctgagaggaccctgtgctgaagacctgggaaggcagttgggggaacttcagtcaatgtctgaagacctgagaaccaggagggacagtgtccaagtgcaggaagagatggacaacccagctcaagtaaggagtgaattctcccttcctttgcctttttgtcctatttaggccctctgggaattgcacgatgcccactgatctttactcagtcttattattctttagctgcttgattgtgtccaactcttttgctaccccatgggctcttctgttcatgggatttcccaaggaagcatactggagtggtttgccattgatctaaatgttacagaaacactttcatagacacaccccaaaacaatgttttaccagcactctgggcaccccttagcccagccaagttgacacacaaaattagtcatgttgacgcattacatcaattaaagcaaaattataaacatattctgtgtgtgtcaccaaatatagaatatttttatatagttcatgaggaactgcttgagatccagtggtgtactctttccattaactttaacaatagtcaactttcctctatagaaagtagatttgggttttgaaaaacagccaagagtaattcagagccaagtctctgtagatggcttttgagacttgaagccaagtgagtcatgcaaggtgagtgacagtcttaggaaatactgtttttgactgaggcatgatttccttccaacactcctgaactgacccaggaaagcagttttgaaggagtaaaacatgaggtgagcacacaactgcggtcaggacagccactcccaaagtggtcattttgaacagaattagaagacatagatgattatgaaaagtcgttcttatgagtttatcttaatacatcattttatgttatcattgctgtctatgaggaaagacaggggcaaaactcattatggtttggaaaaattatgacgtttccagtttacagctgttggcaaaagaaattgcacgttttattacataattttcttggtactgtattagtaaaacatgctccatagcagcggttatccaggtgctttacataatctggatgcagtggatttgtgatggtgaatttaaccactatagtttcaatataagagttccacgacatgtgtggctttataattttgctaaagtaagatttaggtctcatgggttagaaagtttgtgtgggacttcccaggtagtccagtggttaagactccatgcttctgctgaagagggaacgggttcgattcctggtcttagttagagaaatgtaaatcaaaactgcaatgagctatcacctcacactggtcagaatggccatcagcaaaaagcgtacaaaccaaaaacgctggagagggtgtggagaaaagggaacactcttgcactcttggtgggaatgtaaattgatacagccactatgggagacggtatggagattccctaaaaaactgggaataaaaccaccattagtcagtcagtcagttcagtcgctcactcgtgtctgactctttgcaaccccatggactgcagcacaccaggcctccctgtccatcaccaagtcaactcaaactcatgtctattgagtcagtgatgccatcccaccatctcatcctctgtcgtctccttctcctcccaccttcaatctttcccagtatcagggtcttttccaattagtgagttgttcacatcaggtggccaaagtgttggagtttcagcttcagcatcagtccttccaataaacacccaggactgatttcctttaggatggactagttggatctccttgcagtccaagggactctcaagagtcttctccaacaccacagttcaaaaacatcaattcttcagtgctcagctttctttatagtccaactctcacatccatacatgactactggaaaaaccatagccctgactagacagacctttgttgacaaagtaatatctctgctttttaatatgctgtccaggttgattatagattttcttccaaggagcaagcatcttttaatttcatggcttcagttaccatctgcagtgattttggagccccccaaaacaaagtctgtcactgtttccattgtttccccatctatttgccatgaagtgatgggaccagatgccatgatcttagttttctgaacgttgagttttaagccaactttttcactctcctctttcactttcatcaagagactcttcagttcttcactttctgctataagggtggtgtcatctgcatatctgaggttactgatatttctcccagaaatcttgattgcaacttgtgcttcatccagtccagtgtttctcatgaagtactctgcatataagttaaataagcagggtgacaatatgcagtctttatgaactcctttcctgatttggaaccagtctgttgttccatgtccagttctaactgttgctttttgacctacatacagatttctcaagaggcaggtcaggtggtctggtattcccatctcttgaagaattttccatagtttgtttttatccacacagtcaaaggctttggcatagtcaataaagcagaagtagatgtttttatggaactctctccatacatctcaccctctcccattgttcattgcagcactatttacaatagctagaacatggaagtaacctagatgtccatcgacagatgaatggataaagaagttgtgatacatatacacaatggaatattattcagccacaaaccgtcttgaaaatggaagccacgaaaaggaatgcatttaagtcaattctaatgaggtagatgaacctagagactattatacagagtgaagtataaagataaaagagaaagataaaaatagagtgagagataaaggaaaagataaatattgtatactaacacatatatatggaatctagaaaaatggtactgaagaatttatttgcagggcagcaatggagaaacagccatagagaatagacttatggacatggggagaggggaggagagggtgaaatgtagggagagagtaacatggaaacttacattaccatatgtaaaacagatagccaacaggaatttgctgtatggctcaggaaacacaaacaggagttctgtatcaacctaggggagggagatgggagggaggttcaaaagggaggggatatatgtaaaaaaaaaaaaagggtttatgtgggacttcccaggtagtccagtggttaagactctatgcttccactgaagagtgcatgggtttaattcctggtcagggaacttagatcttgcatgtcaactgatcccagagtaaatataacataaaaccaacaattaacagccaaagtataaactacaataacacaaaacaatacaaagatgcagccatttggaaactgaaactccctctcctaaatcttgggtctttgagaaatcagatatgtagttacagaatatttggaagaaaaaattatactaacatttaatattaaaataaagcaaatggagaaggaaatagcaacccactctggtactcttgcctggaaaatcccatggacggagaagcctggtaggctacagtccatggggttgcagagtcagacacgactgagcgacttcactttcactttcaaagcaaattgatggcgttaaaaaaaagcttgtgtgtccatgtgtgtgggacaggatgggtgggcgaagggttttcgttcatggggtaactggttcctgagtccttgctttcacatgatgtcatcttttttattgataagccctattttcactgggaaaaaaactcatccctaagagaaatggaggcagacattctattttgccatttgggaattaggaacattttggaagatgtccttcaagaaggttgaggacttatcgtcttgcgcatgtaaacatctctgcatgcttctctctctttcaaacacatagtcagtgcaagaggtgacttcctttgcctagaagagaataaaaaaattggatgggatcttggagatcagtgaccctattttagagtcaagaaaccaggtctttgagaagtcacatggcccacccatccccacactctgagtttctgctgaaactaaaatccaggtctgcaggatccccatgcttttcccactgcaccgtgatctctattgcccaacaacctctctgctttatagcagtgtctgtggaaagctaagggctagctctgcttacagtgaacccacctgaggttcacccaccacttcaggagatggtgcggtgagcagcccggagtactaaaatggaaattctctgtggaacttagaacatagaatgaggcagaccctactttcaatattttttttttttttttgaagagccacatgcagttggcctcgtttaaaaattggctattttttggcttgattatcagatcagatcagatcagtctctcagtcgtgtccaactctttgcaaccccatgaatcgcagcacaccaggcctccctgtccatcaccaactcctggagttcactcagactcacatccatcgagtcagtgatgccatccagccatctcatcctctgttgtccccttcttctcctgcccccaatccctcccagcaacagagtcttttccaatgagtcaactcttcgcatgaggtggccaaagtactggagtttcagctttagcatctttccttccaaagaaatcccagggctgatcttcagaatggactggttgtatctccttgcagtccaagggactctcaagagtcttctccaacaccacagttcaaaagcgtcaattcttcggcactcagccttcttcacagtccaactctcacatccatacatgaccacaggaaaaaccatagccttgactagacgaaactttgttggcaaagtaatgtctttgcttttgaatatgctatctaggttggtcataactttccttccaaggagtaagagtctttgaatttcacagctgcaatcaccatctgtattgattttggagcccagaaaaataaagtctgacactgtttccactgtttccccatctatttcccatgaagtgatgggaccggatgccatgatcttcgttttctgaatgttgaactttaagccaactttttcactctccactttaactttcatcaagaggcttttgagttcctcttcactttctgccataagggtggtgtcatctgcatatctgaggttactgatatttctcccggctatcttgattccagcttgtgtttcttccagtccagcgtttctcatgatgtactctgcatataagttaaataaacagggtgacaatatgcagccttgacgaactccttttcctatttggaaccagtctgttgttccatgtccagttctaactgttgcttcctgacctgcatacagatttctcaagaggcagatcaggtggtctggtattcccatctctttcagaattttccacagtttattgtgatccacacagtcaaaggctttggcatagtcaataaagcagaaatagatgtttttctggagctctcttgctttttcgatgatccagcggatgttggcaatttgagctctggttcctctgccttttctaaaaccagcttgaacatcaggaagttcatggttcacctattgctgaagcctggcttggagaattttgagcattactttactggtgtgtgagatgagtgcaattgtgcggtagtttgagcattctttggcattgcctttctttgggattgtaatgaaaactgaccttttccagtcctgtggccactgctgagttttccaaatttgctggcatattgagtgcagcactttcacagcatcatctttcaggatttggaatagctgaactggaattccatcacctccactagctttgtttgtagtgatgctttctaaagcccacttgacttcacattccaggatgtttggctctaggtcagtgatcacaccatcatgattatctgggtcgtgaaggtcttttttgtacagttcttctgtgtattcttgccatctcttcttattatcttctgcttctgttaggtccataccatttctgtcctttatcgagcccatctttgcatgatatgttactttggtatctctgattttcttgaagagatccctagtctttcccattctgttgttttcctctatttctttgcattgatcgctgaggaaggctttcttatctcttcttgctattctttggaactctgcattcagatgtttatatctttccttttctcctttgcttttcacttctcttcttttcacagctatttgtaaggcctccccagacagccattttgcttttttgcatttcttttctatgggaatggtcttgattcctgtctcctgtacaatatcacgaacctcattccatagttcatcagtcactcattctatcagatctaggcccttgaatctatttctcacttccactgtataatcataagggatctggtttatgtcatacctgaatggtctagtggttttccctactttcttcaatttaagtctgaatttggcaataaggagttcatggtctgagccacagtcagctcctggtcttgtttttgctgagtgtatagttcttctccatctttggctgcaaagaatataatcagtctgatttcagtgttgaccatctggtgatgtccatgtgtagagtcttctcttgtgttgttggaagagggtgtttgttatgaccagtgcattttcttggcaaaactctattagtctttgccctgcttcattccatattcaaggccaaatttgcctgttactccaggtgtttcttgacttcctactttttcattccagtcccctataatgaaaagaacatcttttttgggtgttggttctaaaagatcttgtaggtcttcatagaaccgttcaacttcagcttcttcagcgttactggttggggcatagacttggattactgtgatattgaatggtttgccttggagatgaacagagatcattctgtcgtttttgagattgcatccaagtactgcatttcagactcttgttgaccatgatggccactccacttcttttgacgtattcctgcccgcagtagtatatataatggtcatctgagttaaattcacccattccagtccatttcagttcgctgattcctagaatgtcgacattcactcttgccatctcttgtttgaccacttccaatttgccttgattcatggacccgacattccaggttcctatgcaatattgctctttacagcatcagaccttgcttctatcaccagtcacatccacagctgggtattctttttgctttggctccatcccttcattctttctgaagttatttctccactgatctccagtagcatattgggcacctactgaccaggggagtttctctttcagtatcctataattttgccttttcatactgttcatggggttctcaaggcaagaatactgaagtggtttgccattctcttctccagtggaccacattctgtcagatctctctgccatgactcacccgtcttcagttgccccacgggcatggcttagtttcattgagttagacaaggctgtggtcctagtgtgattagattgactagttttctctgagtatggtttcagtgtatttgccctctgatgccctcttgcaacacctaccatcttacttgggtttctcttaccttgggtgtgaggtatctcttcatggctgctccagcaaagtgcagccattgattataggtcctcttaaaaacttaatattgtaacatttttgaatcagtatttcctactggataagaagtaaaacacagaccacaggaagtgagtgcatgcgatgtccactaccatgctgcctcttgagcccaggtctgaccttggaatcctcaatgggcagccatgaccaatcaatcagaattgatgcaccaattggtgggggcttcccatgtggccctagtggtaaagaatcaggagtgcttgacaattcaggagatacaagaaacacagattcaatccctgggtcaggaagagcccctggaaaaggcaattgcaacccactccagtatccttgcctgggaaatctcatggacagaggaacctggcgggccatggtcagtagggtcgcaaagagttggacatgagtgaagtgacttagcatgcatgcatgcatgcaccagttgatgaaaactggtcctaatattgggctttcatggtggctcaggtggtagagaatctgcctgcaatgcaaatccaggagacccatgtttgatccttgggttgggaagatcctctgaaggaggaaatggcaacccactccagtattcttgcctggagaattccatggacagagaaacctggcaggctacagtccatggagtcacaaagagttggacacaactgatcaactaactgtcctgatattgcagcttgctccaacagagctggtcataggagattatctttctacctgtcttctgtttctgtctatctatctctactgtatttgtcatctatctattatctgtctatccatcatctatctaatataaatacatatttatatattatatagcaataatgatggtgataagcataacaactcatatttactgagcttccctggtggctcagcagtaaagaatctgcctgtcagtgcagaagatgagggttgaatttctgggtcaggaaaatcccctggagaaggaaatggcaacccactccagtattcttgcctggagaattccttggacagaggaacctggtaggctacagtccacgggcttgcaaagagtcagacacgacttagtgactaaatgacaatatttactgagtccttactgtacaccagacccttgctacacattctactgttaacatctcatttattttcaaggcaaccttataaatatgtatgaatatcctaattttacagataaagaacctgaggcagagagaggttgagtagtgtgcctaaaacctcagacctgtcagtagaagccccccagaccatctactttctgaggtcccactcttaatcactctgccacctttgcagcttctagacgctgacaagtggactgacaataaagcactggtcccacatccagtcctgcacagggatctgccaagacctccatttccatcatttctgtttccatgacgcctctttgcctggcctcctttggactgccatctgtcatctaaaggccaggtgtctccctggcccttgggtctcaggacatgagattcccattgccctggccactctgtcattagaagacctgccagagaaagcaggtgggctggcttcactggctcaagggtcactgttgggctgacttcactgtgaaacccattctggtaggtggtgtcggcggctggcacacacccctgggtctcagagcctctgccctccttgtcctgctcattggccaggactctcaccaagataaggtagaagcagatccccctctccctgtcatctttggggaagaagtgacagagctcagttcactcttcaggaagagttgtggactccctgctctaagatccaaagtctggaacagcataaatgtgttacttgctatccatcagtagatcaaagggaggagttcttggcttgatttgtagaaagaagttccttaagaattaaaatctgacactgatatgtattggcaaagatagggagcaccaggcatcacccatatcctacggttggtagcataattgctaaaccactttggggagccctttggttgcatctggacttccctggtggctcagatggtaaagagtctgcctgcaatgccagaaacctgggttcgattcctgagttgggaagatcgcctggggaagagaatggccaccaactccagtattcttgctttgagaattgccatggacaaaggagcctggtgggctatagaccatggtgtcgcaaacagtcagacacaactgagcaactaacactttcacttcacttcacttggttgcacctaggaaagtggacagtgtgtacactctaagatccatcagtttcactctttgatgtttttccaggaaaaacatgcacgtgtgcaagaatgtttattgcagcatttgtgtgatagtgaaagtagaaaaaaaaatataatgtattaacaaggtcgtggagaagaggacaatgaggaagggactctgaggggatttgttgggaaaaggataaaagaagatcgactgtggatggagaacagggtgtgaagcagaggggagcactgggaagtgaaggggatgtgatggggtctggcagcagaggcctcaggagctggcttctgccttgctctgtagaggaaaggggctttgacctcaggagaaataaagtgtgaccttggctgcacttctgaaattgaccaagaagattacactatattttcactgtaggttttccgatctgaaagcaaagactagaacataaggttccttgaagaggggacatgactgattaattcctcaattacattatccttcctttattgagtatagaaatgtctgaatttcttgggcttccctagtggctcagtggtgaagaatctgcctgccaatgcaggaaacatgggtttgagccctggtctgggaagatcccacatgctgcctgacagttaaacccgtgcaccgtaacttctgagcctgtgctctggagcccaggggctgcagctactgaaacccacatgccctagagctcgagcgccacaacaagaggagccaccacagtgagaagtcgtgctctgcaacgaagagtatcccctgctcgctgcgactagaagagagccctcacacggcaatgaagacccaacacatccaaaagtaaacaagtaattctttaaaacagaaatttctgaatttctttatgttgctaagatagttctggatttcttggaaacacatccttgttttgtcagctattggtttcgtcagctctgtttttggctgtctcatgtacagtattcagcttttgttctttaaaggaagaggtatcagcaatcctaggccaaggaccaaccctagacatcaggagatattgacttcattgctaactccatcaatagccagcttcacaggatatccctccgtcccctgtgctccctcttgggtttatttatcctctacccattggtaagtcatattgtctcaaattgagaaagtcattgttttggacagaatgtttgtatatccccccagattcatatgctgaaactcaactctccaatgtgacggtagtagaaagtgggaggtcttcccaagtggcactagtggtaaagagcacacccgccaatgcaggagacgtgagagatgagagtttgattcctgggtcacgaagatcccccagaggagggcatggcaacccacaccagtattcttgcctggaaaaccccatggacatgattgaagcaacttagcatgcatgcacgcagagaggaaaagaaaaataagtgtcaagcgttcctactgtcggccttttctcacatgaatttaaaactggaactcaggaagaacaagatggcagaggagcaggtggacgtggaatacatctctctccacggatacatcaggaatacaccttcagacacagaagtgcatgcagaacaccagctgagagcccacaggagtacctgaccagcggaaaagaatatatagaacacacaaaactctgtagaatgaaggaactaggggaaaaaaacaggggtgttgctagaactggacctgaccttggcaggtgggggaactaaagcaggggtccgatcctcatatcagggcaattgtctgtcaaaggagaaccagttaaggctgagagtgaaaccgcctaaatggaatgagaatcagacagtccttccacagccatgcatacccagagagggatgtggatcccttggaaggcacagcagctaggagctggattttagggattgtggagcaatccctgggagagggctgctgttgactgtggagagatggatcgaagggatgtgagggaggagattgatgggaaatgccttggaggaaagccaggcagccatggaagcaaggggatactgctgagtcacgcatagggggtggagccatcaccatagcctctgtctctccacacaccagcatcggcagatgaacaatagagagggctgcccatcaaacacctgaggcactaaactagagaacaggatcccacctggggttctcctttgagtgcctgagtgccaaactacagagcaggaacccagccagggtgcccctttaagtgcctgatgcaccgatctacagagtaagaccccaaccagggggggcccctctatgtgcctgacacaccaaacaacagagaaggaccccaggcaagggagccctgtaagttcctgaatgggcagagctacagagaaatactggccaaagaggccttctgatcaccagctacaagaggctcaaaaaagactcagatagggccataacacctgtgtgtgtcagaggtggtccgtgtccctgcacacttggcactgccagggtcccctcaatccaagcagttacaccaccttcatgctcaactctcactggggcagagctgccacaggtgaaaaaaaaaggcttgggtcgtgttcaactctttgcaaccctgtggactgtggcctgccaggtttttctgtcagggagaagggttctccaggcaagaatactggagcacattagccaatactgcttgccatacccttctagagctctatatttcctgcttccctagccaccaacccccctgagtacctggtgctgccagaaacactgcagcccaagcagctgcaccacctccacacctggccctcacggggcacaccgaagtcctccagggcagcctcaggagaaaaccccaatggacgacccaaatgcagaggtggaaataagaccacagttgaaacccaggggcagtgtggctaaggaagaagacctaaaaccttaccaccagttgtacaagctgcagattaaatccgcatgatcaaccaggcagaccctgtgtctgtggaatatataaaaggtcactgagagctcccacaagagaaaactcattagttctgatagctgcggacattgagggaagaacacacaggaggaggactagagtagaagctgagctgccccacagcaggtccagagaccagcgcagcgtcagagggcatcctagagaggtgaggtggcctgtgactcccagcgagggaaaggactctgacagcggcgactcaagaaaaacgcttattattcttatgttttgacttgttctgtagattctttcggattttttttttaaccttttttctcccctctccccacctctgttatagttgtcgattttattgacactatgaaatctaattaagctttttagctttttttttttttctctcacattttttattgttgttataaatctctgcctctacattgggctttagtggttctatggagttttccttttattttttctttcttcttcctttttttttcttttctgttttttaaaatttttaaaaacctattattatttttcctacatttattcctgtgtttgcttttcctactgttcttttctccttgaagttaatctttaatgtatataaatcttctttttccacctctatttaactttgcatatctgttctttctttctcaacatatttgttagttttgttttcattgctttattccccacttggttccttgttttaattttgctttccagattgtgctttagttagttttgttcttaactggtagatataatttttgatttcctttgtttgtcagatcaatctactgtactttatttttgttggactgttttgattttgcttatgggtatatatgtatatattccattattttaattattatttgcctgattttgtaaccgctgtttgtctggggttcatctttggtttctcatttttgggtatttgctttaatctcacttaatgccataacaaaccacttgtggaatctttgttcctgaccagagatcaatccctgagcctttggagtggaagcgctgactccaagaccctagactcccagagaaataagtgaagggagtatcaaatagtgagaatttacacaaaggaaaccacttgaatacaagaccaggcatcacccaaccaccagtagcactctgtgcagaaccccgaatctaaacaacaaataaaacaaaaagcccaaaaaacaaaaagcccaatcatcagcagacaggatcaccacttcactcagccttgcccatcagaggaaaaacaagcaaacaaaaaaactcagcacaaatctcaccctatatgaagcttacacaaaccactggaccaaacttaggaaggaagaaaccaaaaggaagaaagaattcaaccttgaaacctgggaaaaggagacctcaaacacaataagttaaaaaaattaatgaaaaggcagagaaatactacacaaatgaaggaacaggctagaagtccaaataaatgaagagaaaataggcaaactctctgaaaaagaattcagaataatgatagtaaagatgatcaaaaaccttgaaaacaaaatggagaaaatgcaagaatcaattaacaaagacctagaagaattaaagaataaacatacagagacaaacaacacacttactgaaattaaaaatactctagaaggaatcaatagcagaatatctgaagcagaagaatgaatcagtgagctggaagataaaatggtggaaataacttctgaaaagcagaataaagtaaaaagaatgaaaagaactgacggtagtctcagagacctctgggacaatatcaaacacaccaacattcaaattatagagttcccaaagaagaagagaaaaagaaagggtatgagaaaacttttgaagagattatagttgaaaatttccccaacctggaaagggaaatagtcaatcaagtccaagaggcacaaagagtctcatacaggataaacccaaggagaaacatgccaagacacatactaatcaaactaacaaagactaaacacaaagaaagaatattaaaagcagcaagggagaagcaacaagtagcatacaagggacaccccatcagtttaacagctgatctttcagcagaaactctgcaggccagaagggaatggcaggatatatttaaagagctgaaagggaaaaatctaccacctggctaggatctcattcaaaactgatgaagaaataaaaagcttttcagacaagcaaaagttaagagaattctgtaccaccaaaccagctttacaacaaatgttaaagggacttagatagtcaagaaatacaagagaagaaaaagatctacaaaatcaaccccaaacaattaagaaaatggcaatagaaacatatatatcaataattactttaaatgtggaaggattaaatgctccaaccaaaagacacagactggctgaatggatataaaaacaagacccatattatgctgtctacaagaaacccacttcagacctaaagacacatatagattgaaagtgagagggtggaaaaatacattccatgcaaatggaaagcaaaagaaagctggagtagcactcctcatgtaggacaaaacagaccctaaaaaaggaagattacaagagataaggaaggacactacataatcatcgagggatcgatccaagaggaagacataacaattgtaagcatctatgcaccgaatataggagcacctcaatatgtgagacaacagacacaagaggagaaattgacagtaacacaataatagtagaagactttaacatcacaatcaccccaatggacagatcatcaaaacagaaaattaataaggactacaagtcttaaatgatacattagatgagatggatctcatagatatcttcaggacattccatccaaatgcagaagaaaacaccttcttctcaagtgcacacagaacattctccaggatagaccacatctggcatcacaaattaaacctcagtaaatttaagaacattgaaattatatcaagcatcttctttgaccacaacactatgaaactagatatcaattacaggggaaaaaagtgtaaaaaacacaaacacatggagattaaacaatatgtttctaaatagccaagaggttactgaagaaatcaaaaaggaaattaaaaaatttctggaaacaaatgacagtgaaaacatgacaactcaaaacctatgagtgagtgaagttgctcagtcatgtcccactctttgtgaccccatggactgtagcctaccagactcctcaaaacctatgggatgcagcaaaagcagtcctaagaggatagcaatacaatcctaccttaagaaacaagaaaaacattgaatagacaatctaactttacacctaaaacaactggaaaaagaagaaaaaatccccaaaattagtcgaagaaatgaaatcataaacttctgagcagaaataaatgaaaaagaaatgaaagaaagtaaagattaataaaactaaaagctggttctttgagaagataaacaaaattgacaaaactttagccagactcatcgaaaaaaaaaagagaagaatcaaatcaacaaaatttggaaaaaaaaaaaacaaaaccatgaaacgggagaggttacaacagacaatgcagaaatacaaaggattataagagactattatgaacaattatgtggcaataaaatgtataacctagaagaaatggacagattcccagaaaagttcaatcttccaagactgaaccaggaagaaatagaaattatgaacaacccaattacaagcactaaaactgaagcttggtcaaaaatcttccaaaaaaacaaaggcccaggacctgatggcttcacaggataattctatcaaacatttagagaagagctaacgcctatccttctaaaactctttcaaaaaattgcagaggaaggaacacttccaaactcattctgcgaggccaccatcaccctgataccaaaatgaaacaaagacaacacaaaaaaagaaaactacaagccagtatcactgatgaacatagatgcaaaaatcctcaataaaattttagcaaacagaattcagcaacacatcaaaaagctcatacaccataatcaagtttggtttattccagggatgcaaggattcttcaatatatgcaaatcaatcaatgtgatacaccatattaacaaattgaaagataaaaaccatgtgataatctcaatagatgcagaaaaagcctttgacaaaattcagcacacatttatgattaaaactgttcaaaaaatgagcatagaagaaacctacctcaacacagtaaaggccatatatgataagcctacagcaaacattattctcaatggtgaaaagctgaaagcattccccctaatatcaggaacaagacaagggtgtccattttcaccactattattcaacatagttttggaagtcctagctacagcaatcaaagaagaaaaagaaataaaaggaatccagatcagaaaagaagtaaagctctcactgtttgcaggtgacatgatactgcatgtaaaaaaaccctaaagactgtatcagaaaattactagagctaagcagtgagtttaacaaagttgcaggatacaaaatccatacacagaaatcacttgcatttctatatactaacaatgaaaaatcagaaagagatattaaggaatcaaacccattcaccattacaataaaaattaaatatctaggaataaacttacctaaggagacaaaagaactgtacacagaaaattgtaagacactgatgaaagaaatcaaagatgatataaacagatggagagatattcattgttcttgggtaggacgaatcaatattgtgaaaatgactatcctaccaaatgcaatctacagattcaaggcaatccctatcaaattaccaatggcattttccacagaactaggacaaaaaatttcacaattcatatggaaacacaaaataccctgaatagccaaagcagtcttgagaaagaagaataaagctggaagagtcaaccttcctgacttcagattatactacaaagctacacatcagacagtatggtagtggcataaaaacagaaatatagaccaatggaacaagatagaaagcccagaaatgaactcatgcacgtatgggtaccttatttttgacaaaggaggcaagaatatacaatggggcaaagacagcctcttcaataaatggtcctgggaaaactggacagctacatgtaaaagaatgaaattagaacacttcctaacaccatacacaaagataaactcaaaatggattaaagacctaaatgtaagaccagaaactgtaaaactcagaggaaaacataggcagaacactcaattacataaatcaaagcaagatcctctatgatccacctcttagagtaatgggaataaaaacaaaagtaaacaagcaggacctgattaaacttaaaagcttttgcacagcaaaggaaactataagcaaggtgaaaagacaaccctcagaatgggagaaaataatagcaaatgaaacaactaacaaaggattaatttccaaaatatacaagcagctcatacaactcagtgccagagaaccaaacaacccaatcaaaaagtgggggaaggacctgaacagacatttctccaaagaagacatcagttcagttcagttcagttcagtcactcagtcgtgtctgactctttgcaaccccatggactgcagcacgccaggcctccctgtccatcaccaactccctgagtttacccaaactcatgtccattgagttgatgatgccatccaaccatctcatcctctgtcatccccttctcctcccaccttcaatctttcccagaattggggtcttttcaaatgagtcagctcctcgcatcaggtggccaaagtattggagtttcagcttcaacatcagtccttccaatgaacactcaggactgatctcctttaggatggactggttggatcttcttgcagtccaagggattctcaagagttttctccaacaccacaattcaaaagcatcaattctttggtgctcagctttcttcactagtggcgaagaaacacatgaaaagttgttcaatatcgctcattattagagaaatgcaaatcaaaactacaatgaatcacctcacaccagtcagaatggccatcatcaaaaagtctgcaaacaatcaatgctggagagggtatggagaaaatgggatgctcttgcactgggggtgggaatataaattgatacagccactatggaagacagtatggagattccttaaaaacttaggaattaaattaccatctgacctagcaatcctactcctaggcatataccctgaggaaaccaaaattgaaaaatacatatgtatcccattgttcattgtggtactatttacaagagctagaacatggaagcaacctagatgtccattgacagatgaatggataaagaaggtgtggtacacatacacgatggaatattactcagccataaataggaacgcatttgagtcagttctaatgaggtggatgaacctagaacgtattatacaaagtgaagtaagtcagaaagagaaagatagatattgtattctaacacatatgtatggaatctagacaaatgttactgaagaatttatagggcagcaatggagaaacagacatagagaatagacttatagacacaggaagaagggaggagagagtgagatgtaaggagagagtaacatggaaacttacattaccatatgtaaaatagatagccaacagcaatttgctgtatggctcaggaaactcaaacaggggctctgtatcaacctagaggggtgggatggcggggggagatgggagggaggttcaaaagggaggagacatatgtatacctatggctgattcatgttggcaattgaaagaaaacaataaaattctgtaaaaaaattatcattcaattaaaaaataaataaaattattatacaattctaaaaaaaactggaattcactctgtggatgataactgtgttccatctcccagagactgaaatcaccaaagtgaaagtgaaagtcgttcagttgtgtctgactctttgagaccccgtgaactgtagcctgtaggctcctctgtccagaaattctccaggcaatggaattctccaggcaagaatactggagagagtagctgttcccttctccagatgttgaggatcttcccaacccagatattgaacccaggtctccagcattgtgggcggactttttaccatctgagccaccagggaagccttaaatcggcaaggagaaatataaaatatgtatcttatatgcttaaagaaataaaggagattactgaaatttaaaagaaggaacaaggcacattacaaaggcccagaaaaagtaataaaattctggatgtaaaaatataataatttgtattgagaactcaaatggttgggttaaacagcagattaggcagctgaagatgcagactgagaaatttattgagaatgcatcagagagagtggcatcaccggctcagtggacatgacagggaagtggtgtgctgcagtccgtggggttgcaaagagctggacacgacggagcgacgacacaaccaccacaagcagagagaaacaagagatggaagtaagaacgataaatgaaaggatgtggaggacagatttgaaaggtcttacaggatttaatcaaaaagaggcttcccttgtggctcagctggtaaagagtccgcctgcaatgcgggagacctgggtttgatctattggtagggaaggttccctggagaaaggaaaggctacccactgcagtactctggcctggagaattccaggcactgtatagtccatggagtctcaaagagttggacacgaccgagtgactttcactttcactcttcacatttagtcaaaaggagagtccagagagaaggatgaagatgcaacatttgaaaagaggatggctcagaattccctccaaacaatgacagatgaatgagcagactcaggaagctcaacatatcccttcatatgataaagacgactttgtacttggtggaacactaagacaaagagaagattttaaatgagaaaacacacagtacctggtgaaggcatgataattagattgacaactgacttctcaaaatcaaaaacagaagcaagacaacattaaatggtatcttcaaaattctgaaagagaccattgtcagtccagaaccatagagctaacttgatacagtctatgaggagaatatttattagtaactttaaagaatagaattcaggaagaaaagaaattcacccagaaggaaaatccaaattacagtcagaaatgaaatagagaaaaacaaaaatgtaaacatttggataaacctaaggaaacaacaaatttaacatgtctaacttcttcaaagatgtcttgactttttgatccctctgcagttctatataaattttagaataacttcttaatttccagggaaaaaacttgctgggagttttattggatcaatttggagataattgatatttttacaatgttgtatcttgctatccatgaacacgatctatctcttcacttactaataattattaattagtaatatagtattaacaacaatgttttatgttgttactcagttgctaagtcatgtcctactctgcgatctcatggacttcagcacaccaggctcctctgtcctccactgtctccaggagttggttcaaatccatgtccattgagttggtgatactatctaaccacttcatccaatgttttatagttatgtgtaaaaattttctggatttattcccacaattttgattttttgtgaatgatggtttaaacctttcctttctaattgttcactctaaaacaaaaggtttgtttatatattttggtgtactaggtcatgcttatggcatgtggatctagctccctgatcagggatcaaacccaggctccctgcattgggagaatgccctggactaccagtggctattcactcttttgtatagatacgcaattgacttttctaaggtgacattgtatccaataatctcaattacttgtgtgtctgattacaagttttatggagctttctatacacaaaatcatgtaattatgctgtataggaataatgacaattttaatttcttcctttccaattcctacattttttcccttccatttggcagtggctagaatctctagtagcatataatgagatatggtgaaaatgagtgttctcactttattttttatctcaggtgggacgctttcagttattcaccatcaatatcatatttgatgtaagattttttttaataaaagattgtcttttcagatccagaaagttctattccaagttggttaaaattttgattatgactggatatgacattcatcagatgcgtttccacatctattaagtggtcatataaaaatttatcttatttattctgttaatattatgtttattaagtaatttttaatttgaagctagcagcaatggttatctaaaataaaaaaatacaacttgatcatgaatgattatcctttttatttatcattgaatctgacttgctagtatcttgtttataatgtttgcatgtttttctgattttttttctctcaaggcagggcaagagatttgctgtagaagtgacctgatatcttagttacaattttttttcttgtggtgagatcttgtaagagctactttcttagtaactttcaaataagtaatacagtatctatttatttatagttaataatgtatttaaaagtaatagcatattaaaaagcagagacatcactttgccaacaaaatgatatagtgactgtacatctgtatagtcaaagctatgttttttccagtagtcacatgtggatatgagagttggaccataaagaaggctgagcaccaaataattgatgctttcaaactgtggtgctagagaagactcttgagagtcccttggacagcatggagatcaaaccagtcaatcctaaaggaacaaccccaattgaactcaaccccaactggaaggactgatgctgaagctgaaactccaatactttggccacctgttgtgaaggactgactcatttgttaatagttccctttgctgtggaaatcttttcagtttgatgtagccccacttgtttatttttgcttttgctccctttgctttagcttctcaggtggcactagtggtaaagaacccacctgccaatgcaggagacgcgggtttgaagatacctgggtcaggaggatcccctggaggagcgcatggcaacccactccagtattcttgcctggagaatcccatggacagagaagcctggtgggctacagtccatagagttgcaaagagttggacgtgaccgaagcgacttaccatacctttgctttagcatctaatccaaaaaatcgttgccaagacagatgttaaggaaatcaccacctgtttttctctaggagttttgtggtttcaggttttacattcaagtctttaatccattttgagttgatttttgtgtaagaagtggtcccatttcattcttttgtatgtggctgtccagttgtccagtaccatttattgaagacatggtcctttctcattgtacattctcggcttcatgtttataaattaactgaccttttatcaattgagaaatattgctctttatctctagtaataatgcttcttgattgaaagactaccttgtttgatagctaaatcaacattcttttagttgctgtttgcatagtgtatttttcatctttttactttcaatattcttagaagaatatatagttttatactcaaggcatcttgtatatcaagttttatatatcaaggcattttatatatatatataaatattatttatatataaaaataatatttatatatatataaaatccagtatgacaaactttgctactttcaaataacatctttatatcaagttttatatatcaaggcattttatatatatataaatattatttatatatataattatttatatatatatatataaaatcaagtatgacaaacttcgctactttcaaataacatctttattcagatgtaatttacataccataagattcaccattttaaaatgtaaaattcactggtttttagtatatccacagagttttgcaaccatcacagctatctaattttagatcatttttattaatcccaaaagaaacacattaacagtcactcttcattacccccggctttcacccttggcaaacactgatctactttctgtctctatggatttgcctattctgaatatttccctggaatcatacagtatgtggtttttgtgactgccttccttcacttaacataatgttttcaaggttcatcatcagaacttcgttccttttattgccaaatcatattccagagtatgactgtaccacattttttaaattcatttatctgttgatggacatttgggttatttctcctttgtggcttttatgaaagatgctgctagaaacattcaagtttctatataaacatattttcatttctcttagatatatatgtgggagtggaatgactgggtcatatggtaactatatgcctagtaatctgaggaattgattggcaaatagttttccaaaattatggcaccattttacaatctcaccaacaatgaatgagaatttcaaattctccacatctttgcctacacttgttatggtctatcttgattctagacatcttagtgggtatggagtggtatgttattgtgttttttgacttacattttcctagtgactattctctaatgatattgagcatatttttatgtgctggtttgcccctgataaatcttcttttcagaaatgtctattcagatcctttactcatttttaaattgagatatttgtgttttttatagttataagaattatttataaattctgaatacaagtcacttatcaggtttatgagttccaaatattttcttctattctatcagtggtgtttcctctttcttggtggtgttctttgaagcactaactctagatcatgaagatttacctgtatgttttcttgtaagtgttttgtaattttaaggcttacatttatatctgtgatctattttgatttatttgaccataaaaagtagagtttatttccagactctcaattctattccattgatttatttgtctgttcttatgccagtagacacaattttgttgttaagttttaaagctgggaagtgtaagttctccaatttttttctttttcaacttggttattctgggtcccttgcatttatgtatgaattttgggatcatcttgtcaatttctatagaaataaaaaggtgtctgggattttgatatgattgtattgaatctgtagatcagttcagtggagtattgccctcctaacagtatgtaatcttctgatccatgaacatggaatgtttttgcatattttaggtattctcttctttcagtaatgttttatggtcttcaaggtacaaatttgtacttattttgttaaatttattcccaagtattttattctttttgatattacaaataaaatgatttcttaacatcattttcatattatttgttgttagtatataggaatacaattgatttttgtatattaattttatgtcttacaacttgatgaacttatttattagtttgaataatttttgcagattcctcaggattttttgtacataaaaattcttctgtacagataaaatttctttatatataagatcaaatcatctgtcaatagaaataatttatatatgcttttccaatttgggtgaattttttttttttttttgctaatcactctagtgactgaactgaactgaatcactctagtatattattgagtagaagtggcaagaatgaacaaacttgtcttgttcctcatcttaggagaaaatgttcagtctctcaccactgagtatgatgctgtgctgtgcttagttgctcagttatgtctgactctttgggacgctatggactgtagcccgccaggctcctctgtccatggaattctccaagcaagaacactggagtgggttgcatgctctcctccaggagatcttcccaatccagggatcaaacccaggtctccgacattgcaggcaaattctttaccgtctgagacaccagggagtatgatgctggctgtgggtttttcctagatgccctatcttcccaggtggcacagtggtaaagaatctgcctgccagtgcaggagacacaggttcaatccctgggtctggaagattccctggaggaattggaaacccactctagtactctcgcctggagaatcccatgggcagagaagcctggcgggctacagcccatggggttgcaaagagtcagacaggactgagtacacatgcatggcatggctgttaatcaggttgaagatgttccttccttttcttagcttatttaatgttttgccacgaaagagtgttggattttgtcagatgctttttctgtgtctattgagaggatcatatggttcctctccctttgtttttggaatactgtgtcttggttgatttttttgatgttaaatcaatcttgcattcctgggatgaatcccactcattcactgtgttttatccttctatctgctgctgactttcaattgctaggttattactgaggatgttttcatctatattccttccaggactcacagtatgcatctgttggtgagtttgatgttgtcctacaggtctttgaagctctgttaatttttctgtattctttttctttttttgttcatttcagtagacatactttcaagcttgctaattgtttctcctggcagatcaaatatgctgttgaaaccctctagtgaatttctcatttcagtcatcctatttttttactctatatttcctatttggcttgttttaaataatttctgtttctttctatttccttttcagtgagatattgaactcatatttttcattaattctctggatatgattattttatttctttgaacatatttacaatagctgatttaaaggctttgtatagtaagatcaacatctgggcttattcagaaatagtttttattggcggcctcttttcctgtatgtgggctatatttacttgtttcttggactgtcctgtcgtttgttgttgagtagtgggcatttaaaataatataatatggcaactttggaaattaggttcatcccttcccctcaacatttgttgttgcttattattgttgttgtttctgtttgtttagagactttcctagacatattctgtaaagttttttgttgttttttttttttttttttgctgttgtgaatggcaagtggagcttctgtttggttagcttaatgctcatctaatgattaggcaaagatttcgttgaatgccttgaacctgtaactacgttggcttctgtgtatgtgtgtgtgatggggaataccatcaatgttccagtaatcgacagttctgttgctctttccatgtcctgcttgtgcagagccccaagatcaaccagagattagcgaattctcacatatttcttaggcatgcatgcagcactgaccataagcatgaccttctagattcaaggaatactcagttcggttcagttcactcgctcagtcgtgtctgattctttgtgatcccatggactgcagcatgccaggactccctgtccatcaccaactcccagagtctacccaaactcatgtccattgagtcagtgatgccgtctgaccatctcatcctctgtcgtccccttctcctctcgccttcaatctttcccagcatcagggtcttttcaaatgagtcagctcttcacatcaggtggccaaagtattggagtttcagcttcagcatcaggccttccaatgaacattggaactattcaaagtctcttatggacatctcattctccacattttctgttagcgtttttggccctttcttgtttggctcaatgaagtcttgccaactgtggcaggtgtaatgttaattaattgcctctgactgctttgacacatgcccagtgagcaagctctgagtcaggtcaattgagagaaggcttatgaatggcgtttcctagggattttccagaaagatcagatactctcagttctctaggactggattcttgggaggagcttcaaacatactctgcttctttctgtggctgctaagtgactgtttaaaggtactgcgtttgtgagcctgatgacttttaaggttaccacatagagatggagagtaggtgggggtaggaatagggtaagttaaaacaccacaaagctcactgtcctaccaagatttggctgcttttcttgaatagatatttcccatattagtctcatattggctaatttctagagttctgaaaaagttcattttgataatgttttgccaatgttctctgtgtttatgaagaagtgaaattttggagatctttatcatgccaacccagaagtctctgcccagtctttgatttttttcccctgtgttatgtggtttgggggatcttagatccccagccagggatagaagctggacccagtagtgaaagcaccaagtccttaccactgaaccaccagggagttcctccaatctttgatttttaatcaaattgtttacagtgaatgaattattctaatatatttgagtttatactcactgttttactatttatattctgtttgtttaatctactttattttcctttttcccttaattttttgctttaaaaaatgattcagttaagttcagtcgctcagtcgtgtccgactcttcgcgagcccatgaattgcagcacaccaggcctccctgtccatcaccaactcccggagttcacccaaacccatgtccattgagtcagtgatgccatccagccatctcatcctctgtcgtccccttctcctcctgcccccaatccctcccaggatcagagtcttttccaatgagtcaacacttcacatgaggtggcccaagtactggagtttcagctttagcaccattccttccaaagaacaaccagggctgatctccttcagaatggactggttggatctccttgcagtccaagggactctcaagagtcttctccaacaccactgttcaaaagcatcaattcttcggcgctcagccttcttcacagtccaactctcacatccatacacgatcacaggaaaaaccatagccttgactagaccattttcactctgttagctttttaaacacacacacacacacacacacacgtgcatacatatatattgctgttcttttagtgattactttaaatgttacaaatgccgttttaaagaatcttttattaattagtatctttgctactttctgataatgttagggccttaaaaccttttaactcaacttccctccctcttgcctcttgtattattattgtatgcattttaatttacatgtgcaggaagtcacacaatacatggctttttcttctagtcaacagacattttgttttacccatgtatttatcctttctgttgcccttgattcctttgtacatttctatctgcctgaagaagtccctttagtactttcttaatacaagtctgctagcaacaacacctgaaaaattcctttatttctctctcagatattttttctgggtgtagagtcttgtgttggcatttattttctcttagcactttaaatatgacatctggcttcgtctgctcaggctgctggaacaaaacatcataaaactgggtgacaaacagcagacatttatttctcatagttctgcagtccaagatcaaggtgctggttgatttggctcctgattaggattcttctgtcttacagatgatcatcttcttgctgtgttctttcatggtggagagtgagagcttctctctcatgtctcttcttacttaggttggtgcaaaaataattgtggttttacagtgttgaactttcggagaaggcaatggcaccccactccagtactcttgcctggaaaatcccatggacagaggagcctggtgggctgcagtccatggcgtctctaaggttcggacatgactgagcgactttactttcaattttcgctttcatgcattggagaaggaaatggcaacccactccagtgttcttgcctggagaatcccagggacgggggagcctggtaggctgccgtctatggggttgcacagagtcggacacgactgaagtgacgtagcagcagcagcagcagtgttgaactgtgccatttgatattggaatatattcttcatgtggttgttatacactgtaatgcacatttcttgctttatttatttatttttttgctaatggcatattacttgcttttattttatacttgcttttgactatagaaatgatgttagacaaaaagccaatttgagcacttcttttattcaggttcaagtgggtcataaagcagtggaaataacttgcaacatcagcaatgcatttggcccaggaacggataatgaatgtacagtggtggttcaagaagttttgcaaaggagacgagagccttgaagttgaggaatgtggtggctggccattggaagttgatactgaccaattgagaaccatcatcaaagctgatcctcttacaactacaggataagttgccaaaaaactcaaagtcaactcttctatagtcatttggcatttgaagcagattggaaaggtgaaaaagcttgataagtgagtgccacatgaactgaccaaaaatttaaaaagatcatcattttgaagtgtcatcgtctcttattctatgcaatagcaacaaatcatttctctattggattgtaaagtgtgaccaaaaatggattttatatgacaaccagcaatgactagttcagtggttgggctgagaagaaactcaaaagcactttccaaagccaaacttgtaccaaaaaatgtcacagtcactgtttggtggtctgctggcagtccgatccactacagctttctgaatcctggcaaaaccattacatttgagaagtatgctcagcaaaccaatgagacgcactgaaaactgcagtgcttgcagccagcattggtcaacagagtgcacccagttcttctccatgacaacgcccaactacacgttgcacaaccaacacgtcaaaagttgaacaaattgggctacaaaattttgcctcatctgccatattcacctgatcttttgccaaccacctaccacttcttcaagcatattgacattttgcagggaaaccgcttctacaaccagcagaaggcagaaaatgctttccaagaattcatcaaatcctgaagcttggatttttacactacagaaataaacaagctaattctttattggcaaaaatgtattgattgtaagggttcctattttaattaataaagacgcgtttgagccttgttgcaatgatttaaaattcatggttcaaaactgcaattacttttgtaccaacctaatataagatcacttcatgggaaatagatggggaaacagtgaaaacagtgtcagactttattttttcggctccaaaatcactgcaaatggtgattgctgccatgaaattaaaaggcgcttactccttggaaggaaagttatgaccaacctagatagcatattcaaaagcagagacattactttgccaataaaggtccatctagtcaaggctatggtttttccagtagtcatgtgtggatctgagagttggactgtgaagaaagctgagtgccgaagaattgatgcttttgaactgtggtgttggagaagactcttgagagtcccttggactgcaaggagatccaaccagtccattctaaaagagatcagtcctgggtgttctttggaaggaatgacgctaaagctgaaactccagtactttggccacctcatgtgaagtgttgactcattggaaaagactctgatcctgggagggattgggggcaggaggagaaggggacgacagaggatgagatggctggatggcatcaccaactcaaaggacgtgggtttgggtgaactctgggagttggtgatggacagggaggcctggcatgctgcagttcatggggtcgcaaagagtcagacacgactgagagactgaactgaactgaactgaatataagttcaggagctgactgtggatcagatcatgaactccttattgccaaattcaaacttaaattgaagaaagtagggaaaaccactataccattcaggtatggcctaaatcaaatcccttacagtggaagtgacaaatagattcaaaggattagatatgatagattgcctgaatagctatggatggaggttcataacattgtacaggaagtggtgatcaaaacatttccagacaaaaagaaatgcaaaaaggaaaaatggttgtctgaggaggccttacaaatagctgagaaaagaagagaagtgaaaggcgaagaagaaaaggaaagatatacccatctgaatgcagagttccaaagaatagcaaggagagataagaaagccttcctcaaaaaaaaaaaaaagaaagccttcctcagtaatcaactcaaagaaatagaggaaaacaatagaatgggaaagactagagatctcttcaagaaagttagagataccaagggaacatttcatgcaaagatgggctcaataaaggacagaaatggtatggacctaacagaaacagaagatattaagaacaggtggcaagaatacacagaactatagaaagatcttcacaacccagataatcacaatggtgtgatcactcacctagagccagacatcctggaatgcaaagtcaagtgggccttaggaagcatcactacaaacaaagctagtagtagtgatggaattccaactgatgttgtgaaaatgctgcacttaatatgccagcaaatttggaaaactcagcagtggccacaggactggaaaaggtcagttttcaatccaatcccaaagaaaggcaatgccaaagaatgctcaaactactgcacaacagcactactctcacacactagcaaagtaatgttcaaaattctccaagccaggcttcaacagtacatgaactgtgaaattccagatgtttaaactggatttagaaaaggtagagaaaccagagatcaaattggcaacatctgttgaatcatcgaaaaagcaagagaattccagaaaagcatatgtttcttttcatcgactatgccaaagcctttgactgtttggatcacaacaaactatggaaaattcttcaagagatgggaatactagatcaccttgcctgctttctgagaaatctgtatgcaggtcaagaagcagcagttagaacttgacatggaataacagactggttccaaatcgggaaaggagtacatcaaggttgtatattgtcaccttatttaacttacatgcagagtacatcatgcaaaatgctagactggatgaagcacagactggaatcaagatttctgggagaaatatcaataacctcagatatgcagataataccacccttatggcagaaagtgaagaactaaagagccttttgatgaaagtaaaagaggagagggaaaaagctggcttaaaactcgacattcaaaaaaaaaaaaaaaactcgacattcaaaaaactaagatcatggcatctggtcctatcacttcagggcaaatagatggggaaacaatggaaacagtgacacactattttttgggatccaaaatcactgcagatggtgactgcagccataaaatcaaaagatgcttgctccttggaagaaaagttatgaccaacctagacagcatattaaaaagcagagacattactttgccatcaaaggtccatctagttaaagctatgatttttccagtagtcatgtatggatatgagagttgggccgtaaagaaagctgagtgtcaaagtgatgattttgaactgtggtgttggagaagactcttgagagtcccctggatggcaaggagaacagaccagtccattctaaaggaaatcagtcctgagatccattggaaggactaatgttgaagctgaaactccagtactttggccacctgatatgaagaactgactccttagaaaagaccccgatgctgggaaagattgagaaggggatgacagaggatgagattgttggatggtatcaccgactcgatggacatgaatttgtgcaagctctggaaattggtgatggacagggaagcatggtgtgctgcagtccatggggtcacaaagagttgaacacaactgagcaactgaactgaactgaatataaggcacttaccctggataattgctcttttggtcctgacttttggttttatgataaccttagtttgaatggtgggtgtcacgtgtgataaattatagcactctggatgaagttacgtacctccataaggaattcgtcctacactctggcagacaacagaaggaagataacctgaatctaatcaggggtgggaagactcaagactgatttgtagcttttgttagggcttggtttgagaactgagaagcttcttgaggattttgtcctgggtgagtcctgaagttgaattttcatttctcagcactgtgaaaccactaaaaactttgttctgtttttcagctgtttctccttgacttttcagcatcatacctgctaagaagaaaatacttcaataggaaaactgatgtggagtgtcagactcacttctctgcttttttttttttaatctcctgaattttgacctctcaagacctagctgttttggcatccacaaacttcaatttttgtctctctctctccccttgtgagatttttatacagctctgctggcttttcagtcccacacaaaagttggcaaatgcctcaaggggaaagcttcattcaaaaagctgggcttcttcagtgcagtttctttctccttgagatctacagtctcaagttctggcatccttaaaaggtctttaatgccttcgatcaggtttttttcttccttttaacccatctttcttgtttttttctatgggagcattgacatgctaagaagttactccatcatagctagagttaaatgtctgaattaatttttttaaaagacaagagaagccaagttctcttcctgtggatcatgggttgaatgtgacttgttgaagaattaacatccttcctttcgatttctcatggctgggagaaggcccagttattgcttcttttggctcctgtgacaaccagtcaagagaggagccactttttggataccaatatagaaaggaaatgcaaattcataaccttgacctgggttgacaagccaaacttgaggccatgagattccttttggagccaagtgtgaggataaatgtcctggtgctgtgagcatgcctctttctctagttgttttctgaagtgatggagaagagccagaggggtaatggaagatgccaaatctaagacgcaggaggatgcatcaggaaaactaggcaattcgcttataaatgtatctgtagcctccaagctgtatctaccaagcaaaaaaagcaaaggagaaatctggcgaacatgatcattaattatgtcatttgactgtttacttcaaccaggttaattggttaactgccaggtttctatgccactttgaattactcagggatggcaaaatgagaagggagattaaagcacacatctgatgctcttctataagctgatgtctatatttggcctttaaggtactttattatgagacattttttgcattttctttggaaaataacagaagagcctcatttggatttccagtccattaactgattaggtcctaagatttggccaattcttcactctgaggctccaggcattattcagccatgtatccaacaaggtgcatgtaagagcaagatggaaagcttctggaggggctggccatgtgcccttggccttggagaacagagtgtggaggcagcatgcaattcattttcaggaactttatgtctctgcattgaaggttattatatacccttctgtattcattcattcattcacttattattgaacatggatcatgtgccaggcactatactaggtatggcagatacaacgatgaatgagacaggatcttcgcccagaggacttcaacatctggttagggagtgggcgctctaggtcaatgatgttacttggatgaacaatgcatgcacggtgaacatgggcacacggagctgggaagatggagtctgcctgaatgggttagagaaggtttgtttcacagagttagaagttgaaactgatagacggcatataaataagattcctgccttgaggggcagaagttggagaggaaagtgttctaagcatggcaacagcacatactaagacacatgggacagcgtgttctggggaaatgccagatgctcactgagcttagagcctggggtgcaggctggaaacggggactctcctgcagtgcttggggagtccctggagagttttaaagacgaatagtcgtttgactaactttgaaacgtcgctgtaatggtaacaggatgagcagagactctggaggcaacaggagatggcttaaagcccaggccactttttcactgtaaccttgaggagtttcccacataccactgaacttaaatagaatggtaacacattccttgaaatattgttgagagaattagaatctataaagcacccaggtcagtatctgaaatttgtcattataattatcgcaagattaatataatgtattggcaagtaggagagtttctgagttagagccctgggttcttttttaaaacatattttaattaatttatttgactgtgacaggcaggagatttgatgacccacacctattgatcatttgcatattatcctatgcgtagtagtgtatttgcaaatattctggttcaagtttgatttaaggcacgtggaaaagctggatttctttgccgtatttgaagttaggggtggccatggatttgctttgaccaatggatcccaagccgtaactaagtgcatcctgatgagtgggagctttcagcaccacttaactatttcctcaatggtatgtcagccaaagtatatccagaaaaatggaactgctatgaatgttatgagataaaggactgatttcagaaattagatattacacaatggtggggggagcgtagaggtgaaagtgttagtcgctcagtcatgtctatcctttgtgaccccatggactgtagtacaccaggctcctctctccatgggattctccaggcaagaatagtggaatgggttgccattcccttctccaggggatctttctgacccagggatcaaacctgggtctcccgcattgcaggcagattctttattttctgagccaatggcgcgggtaagggggaggtggactggaaaagtgacagtctggcaacttagaggattatcaatgaagttgttagccagtcttcctgaagcactggtgagagtggacaagttggagctttcaggggaatataagaggcctgttatatccagccactagagaggggccaagagcagggagcttctggaggtgtccacggaaggctgcctgagtgcatctggcagtgagccttggtcatcgggatctacattccaggacatgagctggatgtggagcagaggaagcaaggacaagctgagatccctggggcatctctgtatttgctgtttctgtatccagtgacgctgttcagaaggtaattgtgctgcttcactttagcctctcaaatcttctttcaaattccccctttaaccaagaaccatccagggaagagaattctggaaccaattttaaccaagaaccatctagggaagagaattctcaagacggaatttccaatttaaccaagttgtccacagaaaaatctagcatagtttttactaacttggcaactacatacaccttttttaaccattactttcaaataagggcagtagaaaaataatgctttgacctaacatgatgaacaactatccatgtacattaaaaaaaaaaaaggtaacttctcccttaaagaggatatacaaagtctccggagtttttgatgggaaatcagattttattcaaatctttgctcccttgtatgtcatgtgtcattttcttctggctactttaaaatttttctctttatttttatttttggcatatagctatgatgtgcctaggtatggttttcatcatatttatagcttctttaaatttgtagatttatgtctttcaccaaatttggggaaatatcatccattatttattaaaacatttttttttccactccaatttctctcatctttcctgagactccaattacatgtattttgatatacctttgatatcttaaacctggttcctactaattttcaatcttttcttttttaactgaacaatctctatggacctatcttcaagttcattgactattgtctccattctgctttcaaggacatacagtgagcttttcatttcaggccatgtgtttttcaattccagaatttctgtttggctctttttttttttttttaatttatattttttactttttttgattgtatctttttttttttattttatttttaaactttacataattgtattagttttgcccaatatcaaaatgaatccatcacaggtatacatgtgttccccatcctgaaccctcctccctcctccctccccataccatccctctgggtcgtcccagtgcaccagccccaagcatccagtatcgtgcatcgaacctggactggcatctcgtttcatacatgatattttacatgtttcaatgccattctcccaaatcttcccaccctctccctctcccatagtttggctcctttgaatgatttctggttctgtttttcttcaagtcaatgaagtgaaatgaagtgaagtcgctcagtcatgtccgactctttgcaaccccatggactgtagcctaccaggctcctctgtccatgggattttccaggcaacagtactagagtggattgccatttccttctccaggggatcttcccaacccagggatcgacgagttaccgtctgagccaccagggaagtccaagtcagtgaatgtagttcaaaagccattgggtgacctttccttggtccttcatttgttgagtagttgttgtttttttttaatactctggataataaattctgttgtggaattctggattctgtaatactctttcacagagttgattgacgttttgctttctttgtttcagcatcatagtttggctgacctcagagtatacgctcactttcaatgctcccatgccctgtgatctttcctggtagagcccttggcttgcttgtttgtttgttttattttggctgtgctgggcctgctttgtggctggtggcactctctagtggtggtgcacatgtttagtttccctgtggcacgtggcatcttagttcctggaccggtgattgaacctgagtctgctgtgtgactcttcagcacgggaccaccaggaaagtccctggtaaaactattttaattgcatgacaagaatggatttacgtgtgagttactcccctactaaattgtaagcttgtcaaagtaagtaactgggttttattcattttttgtgtccttcacatacagcataatgttgcacgcaatgggcttgctacaatgctgaatgcatgaattacttgtaatttaggaaatatccactaaatcaaaacactgttataagaagacccagggggacttccccagtggtccagtgtgggaaagtggttaagactctacacttccaatgcaaaggggtgtgggtttgatccctggtcaggggactaagaacccatatgctgcatgaccaggaaaattataaaaaatatataattagaccagggaagaaagaggggaaagctgggagtcttatgagtacatatcaacatccaccctcctatgcttggagtcattttctattgttaatcctctaccaagaatgtgggcctcagttacagttaatcttcagcatttacaccctcatcttttattccctacagagtgcacatcatagaaagccccattacaataaaatcattaaaacagagggttgtgagtattcaatcgttactttagctgcatttccgcagtgtggaattactctagaagtaataaaaatgaatcacaattcaaattcatgatttgagcttgctcattcatttattgaataaacatttgagcacagtgatgttgagggtactaggtcccagaaatataaaaattaataagcacagttcctgtcctcaaggagtgaagaaaacacagaggttaatcatttaatcagttatttgtagattctacaaatatttgttgagcacctattttgtgctgagaattttgctagaagccagggatacaataatgagaagattactctaatattattttaatcttctcattagaaggtgccctcaggaaactcagagtttctctggaaagtattaactctaagagaggttttcttatgttgtagtcattcaagtactactctcactgtttttttttctttttgccttggcgcatacaacatatactattaattcatattttgtttcactctttaaaatcttaaatcaattccatttaaaaaggaaggttatataacctatatgtactacttacatggatatatactacttatatggctatgctactaatgcttttcaaattcacattaaaaaatacatgattattaaagtacaaaatgactaaatgcaaaataccaagtgttatatgttccacactctgggaaacactgctttaagcacgttaaatgttgttaaaaatatatttatgaagtgcaaagagcttcccaggtggcactagtggtaaagaacttcctgccaatgcaggagacataagagatgtgggttaaatccctggggaagatcccctggaggagggcatggcaacccactccaatattcttgcctggagaatcccagggacagaggagcctggcaggctacagtctgtagggctgcaaagagtcagacacgactgatgcaacttaacgcacacacagagtgcaaaaagtgtaacaggatgaatcctgttatgaggcctgtctatgggggaattccctggtcgtccagtggttgggtctgctgctctcattgccaagggctggggttccatccctagtcagggaactaagatcttgcaagcagcatggcttggccaaaaaaaagaaaaggaaagaaaagtattaacttaaaaaaaataaaaattcctgcctgtgtttataaggaaggctttgcagaaaagtttccttgagggacttccctggtggtccagtggctgagactccacactcccagtgcatggttcctgggtttgatccctcgtccaggaactagatcccacatgccacaactaagacccagagcagctaaacaaacaaataaatattcttttaaaagctgtagatattaaaaaaaagaaaagagaagtttccttgagggagttccagcatccactttaccactttattctctgtgatagtcaaaatagtagcctccttccaaagatgtccacatcctagttggaacctgtgaatatattacattataaggtgtgggctaagtcgcttcagtcctgtctgactctgcgaccttgtggactgtagcttggcaggctgctctgtccatgagattctccagacaagaatgctagagtgggttgccatgccctcatccaggggatcttcccaacccagggatcgaacctatgtctcttatgtctcctgcgttggtagaagttctttaccactagcgtcccctgggaagctcactttgcaaggtgaagagatgttaagattgtggaagaaattcaagttgctcatcagctggttttataaaaaagaaattatgctggatgatgtggaggggccagtgaaatcagaaaggaccttaaaagcagaaaagggggaggaagagagtgagcatgatttgatgttaaaaggactctatggttatggctgcctgtaaagatgaaggaaggggccatgagccaaggaaaccctgtggcctctagaacctggaagaggcaggaaaacaaactctccagaagtccatgcagccttgatttttgacgggtaacccatgttggatttctagcctacaaaattctcagataatccttttgttccctggtgactcaggagtaaaggatctgctcgccaatgcagaagatgtgggttcgatccctgggtcaggaagatcccctggagaaggaaatagcagcccacttcaatatttttgcctgggaactcccatggacagaggagcctggtgggctacagtccatggtgttgcaaagagttggacactactcagcgactaaacgacaacaaagtctgcgatcatttgttacagcagccatggaaactgacaccacccggcagtgccagatgcatctcaggcattggttaaaaataaactaaattgaacggggccttctctctaagttctttaagggcatggaccacatcttcttgtccactgtagacccagtagccacaatcacatttagaaaatagttggaggtcagtgactagtttgagtgcattttgaaggaaggcactatttgaagtgacttttcaagagtgggtgggagttgagacttccctggcggtctagtggttaaaactctcttcttccactgcagggatgtgggtttgatccctggttggggaactaagatccagcatgccgcagggcatggtcgaaaaaatgaattaattcttttttaaaggttaaaaaaaaaaaagagtgggtcaaagtttactatgcttggaaatagactgaggaggggctctggagatgtgggaactgcatgagccaagacatcaacgttcatggtgtgtttggagaaataaatgatcctctggcagaagacagcatgctcaaagagaatgagtggtagctaacccagggcagtggtagggaacaggccagaaaggccttgggtggcatgcccaggagtttgagttgagtcttaatcatcacggggagtcatgtatccatttctttttgcatggcactaaaggccatgggagcttgcacgctctccaagttggtttcttcataatgtccactggaagcttgtttttcctggaaccaggatccttgcaattcatgcagatgtgttgggagaaggcctgatcttaggggcttgggttcttgggctgcgggtcaagtcttggacatcaggagtggccagacagagggagccaagcattctgagaagccgggtgactcccgggctcccttgagcttcctcccagcaggagctgacgagctgtcaaggtttccatcataaatcccacactccatgtgtttgcaatgtggtcacggggatgcacgtgggatcggggcccgggtgtgagggcttagttctggaggcaatgcttcctctcttttcctgtgcctttttgagagagcttattttgctttcgcaaagttacggtgaggaataaaggggcaataatgagttccagatgcttttattttgctccttctataattggaaacaaaaatatagcatggcttttaaattgaaagtgccagagaggaatgatgcttttagctctggggtttgagctgtgatttagagcccagcatgagactctggacgtcatcaccacacaccagcttggccacagggctccctgcagacccagctccaggctttatctcagagtctgaatgaggttcaactgtgagtcctattttaagaaacgctaatgcacggaacccaaacttgcaaagcagacagatttaggcagagtgagcagccacgcattcaaagggtgattgtctcgcagaaggccactgcgcacgcctcttttaattccatctcccttagtgcacctaaaagtttccccgcacgtcgttaattttgggggaaggggacaaagaaccttccagtcgaagttacaagtgtgaagtgccaagtaaggatcaacgaaaaaaaaaaagaacaaaaaagagaccagattcttgaagtgtaaagtgatcttagaaagaaagaatgcttgaattaccacggattgtttgtacaacatctaagttttcaggagatcttgaaaaccaccgtgggaagacctgactctgagccatatgtggaactggaatccttgtgtgttagacaaagcgatcctcctaaaggtgcaggaggaaacacctgagaccttttggaaactttgtttcttcctttttggccaattgctgttgcaaaatggaaccagtgtggaaagtcagatttgggtttagactatgggaaagcacttggcctccactataagacacaataatagcagattatgctctctccagagagatcatttttaacacaaagcagatcctaggcccccactctaaagcaggccaggatggaaagataaagcgaaataaatggccattccatcctgacatgatctgcacagcacactggtacaaacaggcattctggactcagcactgagatctaagtcttttgtttagcaaaccaaatagttcaagatctcctttgatgccaaagctcaggtcagtcttgatgagcaaatgaaactaactgatgtcaccctcgtttatctcactcttgctctctcactgcctttatattttttcaatctattattattattactctggttgcagtgggtctttgttgctgtggacgagctttctctagttgggcgagcaggggctcttctctagtaacggtgcacaggcttctcgttgcgctggcttctctcgctgcagagcacaggcttgagttcagtagttgcagccctcaagttctgtagttgtggtcacgggttctagagcgtggactcagtagttgtagtgcatggactgacttgccttgtggcatatgggatcttcccagaccagggatcgaacccatatcccctgcattggcgggaggattcttaatcactggaccaccgaggaagtccttccccttgccttttatgcaagtaattactcctcagcttcttgagctgccatccactgagtacatacactgtgctggtagacttccagatgtacacattattactcccgttctccagaccttaaactgatcagccagttccaaagcctatagtctttccctgcattctgacctgtctaatcatgagtagctcacaatgtggtctaaagagattgctcagaggtttttaacccttttggaaattttaccgagcttgggggctctgtcctggacttactgagtaagcgcctctggggtcaaagcgcctgtgtctttgagcgaggtgcacagtggtgctacgagccaccgcaagagcatcttaggtgatgcggggcttagggggtgatttgagagatgaccccttttagggagccctctgctctgtgatggggcttcccagtggctcagactgtaaagaatctgcctgcaatgtaggacacccaagttttgtccctgggtcggaaagatccccgagaagggaatggctacccactccactattcttgcctggagaattccgtgggcagaggagcctggcgggctacagtccatggggtcgaaaagagtcggatacgactgagcaactaacactttctgctctgtgatgggtactgaagcctgcccattgcctctcatatggcctgagaagttatccacggagactgaggcaaaggcatactcctcattcctggcaggttctctgaccctagtctagctctttcctgaccttctgagtagactgggcagttcagaaggacactttgggggtccatatcagtcccccttagaccctagagccaggtttctgtccctcccctctgtctcctgctcctattagttctgagcacctgaggaggtctcccgagaagttttccccagttcctatgggaaaattgctaagccagagtttaaaatatggaggaaaaaaggagaaagcttgagaggcacccactccccccagtgcaggccacctgtccccagagatgcagggtgttctcagctcaccttcttccaaacggctggaccttggccagtttccccatcttcccattttgttggtgtctccagtccactgagtattttcaaggtcccacctccaaggggaggaacgggaggcagaacctccaagctaacataactttctgcggttaggggattcttgaggctctcaccctctagaccacagaagccagggaccgctggagctaagcttctaaaagcagacataaacttactcttcctctctaagtaaacacatcaagcctaggtccttttagaaggaaatgaaatgtgtgattttccaaaaaatatctttacaggcacgattgtcttcttggaactcagcttatgtaaataattaagggagtgctccctcagctctttataagtgtccactgcaacactgattttactgagagagcttggaaaccatctacatgggcaataagagaggattaaatcaatgaatcccatcactatggaaagccatgatgtacattcttactctggatcatggaaggttatttatgatattttaagtgccagaagaaggtcacaaaacaatatggacactatgatctcatttttgcatctggaaaaatgcacaccaaactattactaatcactatctctgggtggggagtgaaggtggtttttattccctcctcctttgtgtgtctgtattttctcatgataatactgaagaatgtgcaatctttgttcaacgggtacaaatctaatgctgctgttgagtgaggtcaggcctctgaaagtgaggcagaaagaagagggaacacaggcccctacacaatctccagccccaactccgcttcccaaccgccactgacgtcaacagtcatgatgtgcattacttaccagcaaggtgttcacattttttcattaaccagaagagaaaacagatacaaccagactccacggtaaccacattctgcctgaggttgcctttgtgaagtgctagtctctcagtcatgtccgactctttgtgatcccctggactgtagcccaccagactcctctatccatgggattcttcaggcaagaatactggaatgggtagccattcccttctccaagcgatcttcctgatccaggaaatgaacccaggtctcctgtaggcagattctttacctacttgggaagcccgaggctgcctgtaagagttgtaaactttcaacccaaagcgacccaacctcatagacagttgaactgagaaatacacacttctcctgtcagggttggccagggggcgcggctcccaagttaggagcaattgcgataagagatggtatcaggcagagggagttataacatcactttcatttctggtaaaactgggtttggacaccatggttagttctcttagccaaatggttctgagactcctttgccccagcatgcagtcagaccagggctgttagtggccacacggaagggcttcaggaatcaacagcatgtcttgccccgtgtgactttcagcatcccagagcttcctgcggtccagcagagccacccaaagatggggtcacctgagttgtccagtaaaacacatccactgatcccaacacctccccaaggggagggttaagaaggaaagagaccagagtgttatgctaaagtaaaggtcagcaaactactcccatgggcaacatctgctccctgcttgtttttataaataaacgatattggaacacagccacacatgttcatttgtgtatcatctaaggctgctgtcatgctccatcaccatagctgaggatagactgaaaccgtacagcctggaaagccaaatgctgctgacctctgctctacaggatgtctcatcaggaagactagagaagagagacatttctggctattctgggacacacactctcctctctctggcccgtccagcttgatttcaagtgccagtcctcgaatattaagcttcatcaagatacatgctccccagtgtttatggcagcactattacaataaccaagacatgcaaagtgaccagacacacgaatggataaagatgaggtgtcacacgtatatacacagcagaatattactcagccataaaaaggaatgaaataatgtctgtcaaacactcgaatggacctagagattatcacaccaagtgaagcaagccagacaaagatacatatcatgtgatattgcttatttgtgcgtgtgtgctaagtctcttcagtcatgtccaactctttgtgaccctatggactgtagccttccaagctcctctgtctttggggattctccaggcagaatactggagtgggttgccattctctcctccaggggatcttcctgacccaggcatcaaatccgtgtctcctgtggctcctgcatagcaggcagattctttactgctgaacctctggggaagcccatgacattggttatatgtggaatcgtaaaaaaaaaaaaaagacacaaatgaaataatttatagaacagaaacagattcatagataaaacaaacttatggttaccaaagaggaaatggtgggagagataaattagaactttgggattaacgtatatatactaatatatgtaacaggtcaacaacaaggacctaccatatagcacagggaactggactaaatatcttgtaataaactataattcaagagaatctgaaaaagcatactgctgctgctaagtcacttcagttgtattcgactctgtgcgaccccatagatggcagcccaccaggctcccccgtccctgggattctccaggcaagaaccctggaatgggttgccatttccttctccaatgcatgaaagtgaaaagttaaagtgaagtcgctcagtcgtgtccgactcttagcgaccccatggactgcagcccaccaggctcctccatccatgggattttccaggcaagagtactggagtggggtgccattgccttctccgtgaaaaagcatatgtccatacatatgtatgtatatacctgaatcactgaatcgctgtgtacctgatactaacacaaccttgtaggacagagattcttagacttgaaccctaaggcctgtgagggctgccttccctctgacccccaacccaatgcccttcttcctttctgtttttttgttgttgttcagtcactaagtcgtgtccaagtctttgccattccagggactgcagcactccaggcttccctgcccttcactgtctcctggagcttgctcaaactcatgtccattgagttggtgatgccatgcaaccatgtcatcctcagtcgcccccttcttctcctgccctcaatgtaccccagcatcagggtcttttccagtgagttggctcttcatatcaggtggccaaagtactggagtttcagcatcagcctttaggtaatgcttgaaagcttccaaagcctctgcatcctgaagtcccttcctaaagactgttccttgcagctggaaaactccttcccctattggaacccagatctctgtctaaacctcactccctcactccacaagagactgttactatgtcctcacctgccacacgccctgtgctcttgccctcgtggcaatgacacacactgcaatgatatctatgtggttatttgcttgctgaccatctcctccgccataaactgctggagccactagaagatgtccctttgctccctttgctcgtgtctctttgctcactgtcacacctcagcacctctcttattgttagcatgtgtgtgtgtgtgctcagttgtgcagtcgtgtctaactctttgtgaccccgtgggctgtagcctgccaggctcctctgtccaggggatttcccagccatgaagactagagtggggtgccatttcctcttccaggggatcttcccgacccagggatcaaacccgtgtctcctgcattggcaggtgggttctttaccactgcaccacctggggagccctagtgtcagcatgttcggatcagatcagtcgctcagtcatgtccgactctttgcgaccccatgaatcgcagcatgccaggcctccctgtccatcaccaactcctggagttcactcagactcacgtccattgagtcagtgatgccatccagccatctcatcctctgtcgtccccttctcctcctgctcccaatccctcccagcatcagagtcttttccagggggtcaactcttcacatgaggtggccaaagtactggaatttcagctttagcatcattccttccaaagaaatcccagagctgatctccttcagaatggactggctggatctccttgcagtccaagggactctcaagagtcttctccaacaccacagttcaaaagcatcaattcttcggcgctcagccttcttcacagtccaactctcacatccatacatgaccacaggaaaaaccatagccttgactagacgaacctctgttggcaaagtaatgtctctgcttttgaacatgctatctaggttggtcataactttccttccaaggagtaagcgtcttttaattttatggctgcagtcaccatctgtagtgattttggagcccagaaaaataaagtctgacactgtttccactgtttccactgtttccccatctatttcccatgaagtgatgggaccggatgccatgatcttcatttagcactccacaaatatttgtctgaagatgacgaaacaggacagccagcctccgtggaatcagagtttgaggatcctagttcagccagaatggagactgtgctagtttgctgtggctgctataacaaacaaccatggacttggtgacttacaacaacagaggttttttttcttgtttttctggaggccaagagtctgaaatcaagctgtcagcagagcctgtggaggttccagggaagagtctcttctggcttctggtgactgcagactttccttggcttgtggccacatccctcccttctctgtttccacctcccaccaccatcttcccttctgttgcgaatccccctttttgtggaagtcttataaggacacttgcaatggtgttgagggcccaccagacaatctcatctcaaaatccttacttaactacatctgcaaagaccctttcccccagtaaggtcatattgacaggctgggaattaggacatgaacacactttctggttgtgggaggggagggggagcatttctacacaccatggggacataagactagatgtgatccaacaggaaaaaagatctgtccagggaaattcaggatgaaaacctccgcaaacaagaagacagaatagatttcagtgaccatggagggagaaacatccttaagatgcttcccactggggtcaaaacagacaccagcatcccttccccatttttgcctgtgctcagtctgattctttgagacccctctggactgtagcctgctacgcttctctgtccatgggacttcccagcaaggatactagagaagcttgccatttcctcctccatgggatcttccccggccagggattgaaccttgcatgtcctgcattggcagctgggctctttaccactgaaccactgagggaagcccccatagtatactgatctcagcctaaaggccagcaaaggtcactcgccccagaattgggctcaggggagagccagtttttatcccactgagattcattcatacctgatgagtctgtggcaaggaaccacaaccacagactcacatttgttccataatgttgggaaaaaaagcttcaactaagatagcctcagcttccccaatgatcaatcaagttctctagtcccaagggagcgactgagatgttttcctgccatttttcatgtgtcttgggacaatagtattaatagaaagcattgttatgttcaccaagctagttccttgcaatgactgaatcttactctcaaggctgcttcgaatagctgttaactctccagttgcctttaaaaatatcaacaaaaattcacccccagacttctcaatcaccacacacccgtgtcttttcagctttcaggaagtgtctccttcaactttccctaaagtgtaccaagttattagttaccttaaacctcactgagaaacagatcctctgtgatcaggacttagaatatcttttaaaaggtgtagcttctgaaaacaattgtgttcagttgctcagttgtgtccaactccctgagaccccatggactgcagcatgccaggctttcctatccttcactatctcctcaaactcatgtccattgagttgatgatgccatccagccatctcatcctctgtcgttcccttcttctcctgccctcaatctttcccagcatcagggtcttttccaatgagccagctcttcgcatcaggtggccagagtattagagcttcagctctgaaaacaattaaaagtatgcaaacacgggggcctgcctaggaataaacactactgtatttttagaaggctgggtcctttcatttttaggtaatgagtctaatttgatttctataaaccccagtggtccttctgtggtttaatttagatgggtgcttctaagctgctttctgaaatggcaaggcttctgggtgtgctatttatgaggaagaattggggtgaggttccatttttggcagagggtaaaaataaagatttttctcctgagtgggcccctctcagaatctggctaggtctatactggcacacgtgtacagcatatgtcaggctcgcctccgaagagaggctatgagtcaatccgcctggctccgctctggggagttttaaatcatgctgcttctccaagatgtaaagcggtgtttgattttctgggagggaggttatggatatttttgcagtaaaatatgaacagcgaatacagtcgatccccaccgtgaggacttaaggaacgcaaactaaaagatgaccgtcagatgatttctctaccacaggaagcttctagatccttttcctgtgggcagcaggatggtggtcgccccatgagagggtgagatcatgctttcaatctgcaagcatctttggaagccctcccggggcattggagaaagcactggggtggcgtaggaaacagtgagctgggtgtcatagtgcagcttttaacgaagtgaatcactcagctttttcaaaatcacagtccttgacggtgaactggttcacgatgaccaagttcgagtacagaagtgccatttcagcgcaccgaggtcctttcttccctcgtcactgtatttgaagagggtcattcttgtctgagttatactttggagactccaagactttgctggagatttggagagaatctgggagttagaattaaatctggtatctgctgggactccacacctccaggacactcaaagccactcgacctcctggggccaccctgggaaggtttgcaatctaccagctcccagggtgccaaggtgccaaagctccaacctgctgtagggactcaaaggggaaagacagaaataagttgacctgaccagagcccaaacacaaaggcaggaggcctctgtggacatatcacggactgaatcctcccccagaggcatgaaatctcagagtcgtgcttacagggagggcagaaggacatgcagtcaagggcccatgaagacaacactggaggggaggccaatgctggggaggatggggtgatggcaaaggttgaaaaattgagagagacagatgagggggaggaggagagggagaggaaggagagacaggagcctcttgctgagcctgagataacttcacttccctgcacccagggtaccaaaggggaatgaaggatgtgtgtcgacagggcctggatgcattgaagaaatgcctgtaagtggaggcttggagagagaggggatgggctctggagagagagggggtgggctctggttgctgagtgtgaattcagagaggaggagacttcagaggactttcgctggccctgcactggtccccagggcccctgtgtgtgccaggagcttgaagacaggcaggaagagagtctcaaagcggagagatgttaatggacccattggtcttcaacaccagcacctctgctctgttgagggaaaccgtttcactcagatggtttttgacagaatcctgccatcttcccagggctttctggggggctccgtggtaaagaatctgcctaccaatgcaggagacttgggagactcgggttagatccctgggttgggaagatctcctgaagaaggaagtggtaaaccactccactaatcttgcctagagattcccattgacagtggagcctggacacaactgagcatccacgtatgccatcttcccaccagggcccattctcatccaccttgctctctactccaatcctcactagaactccaagctcctgccttcctccaaaagagatatttcataaaaaaaaaaaaaaatcgtcagctaaacgggtaactccctgagttactcagaggctggactgagtgaggctcatcctgccttgcctccatccacaaggtccccaccagggtccctcttctctgcagttagtgtttcccaactccatccttgaagggcctcaaccactcaggctcacatggaattttctggaacacagcgcacagactgacaaagcctcaggagaggttcctccaagcagacacctagatggatcctgagccagttcctcaatctttttctagtccagcatatgtcgagtctggttagggttcaagctgccttctaggtgacaccttccagagtggtggccctccgacccatctcccccttacctcttctttttctggaacctgcagatgctgcctctgtcagagtaggcttggggtcacggggaaattcccccactacctgtgattggaacatcctaagggggaatgcctgatgctggaaaagattaaaggccaaaagagaaggggatggcagaggatgagatggttggatggcatcactaactctgtggacatgaatttgagcaaactccaagagacagtggaggacagatgagcctggcatgctgcagtccgtgagggtcgcagtcagacacagctgagcgactgaacagcaacaagaggggtggtacttctggaccaggccctttactctgttctgggccagtcaggggagtgggtgctgctctttgactagactggccagctgaggatttagggggacaggagaatcatctgcaaaaatcccccagtgaaacactggctgtgtttgcacacagcttcccataaagatggctgcatctttttaagacaagaagccgctaatcctcttttctgacaagacagttcagttcagttcaattcagtcgctcagtcgtgtctgactctttgcgatcccatgaatcgaagcacgccaggcctccctgtccatcaccaactcccggagttcactcagactcacgtccattgagtcagtgatgccatccagccatctcatcctctgtcgtccccttctcctcctgcccccaatccctcccagcttcagagtcttttccaatgagtcaactcttcgcatgaggtggccaaagtactgagtttcagctctagcatcattccttccaaagaaatcccagcgctgatcttcagaatggactggttggatctccttgcagtccaagggactctcaagagtcttctccaacaccacagttcaaaagcgtcaattcttcggcgctcagccttcttcacagtccaactctcacatccatacatgaccacaggaaaaaccatagccttgactagacggacctttgttggcaaagtaatgtctctgcttttgaatatgctatctaggttggtcataactttccttccaaggagtaagtgtctttgaatttcatggctgcagtcaccatctgcagtgattttggagcccagaaaaataaagtctgacgctgtttccactgtttccccatctatttcccatgaagtgataggaccagatgccatgatcttcattttctgaatgttgagttttaagccaactttttcactctcctctttcaccttcatcaagaggctttttagctcctctttctgccataagggtggtgtcatttgcatatctgaggttattgatatttctcccggaaatcttgattccagcttgtgtttcttccagcccagcatttctcatgatgtactctgcatataagttaaataagcagggtgacaatatacagccttgacgtcctccttttcctatttggaaccactctgttgttccatgtccagttctaactgttgcttcctgacctgcatacaaatttctcaagaggcaggtcaggtggtctggtattcccttctttttcagaattttccacaatttattgtgatccacacagtcaaaggctttggcatagtcaataaagcagaaatagatgtttttctggaactctcttgctttttccatgatccagaggatgttggcaattttgtttctgtttcctctgccttttctaaaaccagcttgaacaactggaagttcacggttcacatattgctaaagcctggcttggagaattttgagcattactttactagcatgtgagatgagtgcaattgtgcagtagtttgagcattctttggcattgcctttctttgggattggaataaaaactgaccctttccagtcctgtggccactgctgagttttccaaatttgctggcttattgagtgcagcactttcatagcatcatctttcaggatttgaaatagctcaactggaattccatcacctccactaactttgtttgtagtgatgctttctaaggcccacttgacttcacattccaggatgtctggctctaggtgagtgatcacaccatcgtgattatctgggttgtgaagatctttttgtacagttcttctgtgtattcttgccacctctccttaatatcttctgtttctgttaggtccataccatttctgtcctttatcgagctcatctttgcatgaaatgttcccttggtatctctaattttcttgaagagatctctagtctttctcattctgttgttttcctctatttctttgcactgattgctgaggaaggctttcttatctcttcttgctattctttggaactctgcattcagatgcttatatctttccttttctcctttgcttttcacttctcttcttttcacagctatttgtaaggcctccccagacagccattttgcttttttgcatttcttttccatggggatggtcttgatccctgtctcctgtacaatgtcacgaacctcattccatagttcatcaggcactctatctatcagatctaggcccttaaatctatttctcacttccactgtataatcataagggatttgatttatgtcatacctgaatggtctagtggttttccctactttcttcaatttaagtctgaatttggcaataaggagttcatgatctgagccacagtcagctcctggtcttgtttttgttgactgtatagagcttctccatctttggctgcaaagaatataatcagtctgattttggtgttgaccatctggtgatgtccatgtgtagagtcttctcttgtgttgttggaagagggtgtttgttatgaccagtgcattttcttagcaaaactctattagtcttcgccctgcttcattccgtattccaaggccaaatttgcctgttactccaggtgtttcttgacttcctactttttcattccagtcccctataatgaaaaggacatcttttttgggtgttggttctaaaagatcttgtaggtcttcacagaaccattcaacttcagcttcttcagcgttactgattggggcatagactcagattactgtgatattgaatggtttgccttggaaacgaacagagatcattccatcatttttgagattgcatccaagtactgcatttcgaactcttttgttgaccacgatgggtactccatttcttctaaaggatttttgcccacagtagtagatataatggtcatctgagttaaattcacccattccagtccgtcttagttcgttgattcctagaatgttgatgttcactcttgctatctcctgtttgaccacttccaatttgccttgattcatggacctgacattccaatttcctatacaatattgctctttacagcatcggaccttgcttctatcaccagtcacatccacaactgggtattgtttttgttttggctccatcccttcaccacagccttgtctaactcaatgaaactaagccaagatgggcaggtcatggtggagaggtctgacagaatgtggtccgctgacaagacattacatatcaaaatagaaagaaaagaaaaccgacggaaaaccaggctcaccacatctgtccttccttcacctgtgccactggggacccagcctgcatggcctgtgcttggcaggtcttgagcagatgcctctgtcggtctcctcttgctttgtctcactaagaaagtctgagtgccttggtctgcctctttgcctggtggccaggctcctctttctgggagaatctggaatagtctacctcttaaagcaaattcttccctgagaaagcacagcttattcaaggaaaatgcccagacaaggaagtcagacatttaggtgaatctttgtttagctctgtgttcttcatcagagtgaagtgaagtgatttcatctctctaaacttcattttccttatttgtatagatgtcaaacatagattcgttgagtgctaactgtgaccttgggctagttacttctctggaccttagtttttttgatcagtgaaatggataaacattgatgtctatttcaaggttgttgctgataccgaattgctgtgtgtaaggggtgactcaggtagtaaagaatctgcctgtaatgcaggagacctgggtttgatccctgggtcgggaagatgccctggagacaggaatggctacccactccagtatttttcctggagaattccatggacagaggagcctggtgggctacagcccatggggttccaaagagtcagacacgccttaagcaacttaacatgcacacatgcctagtgtggctgattaaatatggcctaaagctttgcagctcaataagtagaatctgtccaccttttgaaactgggctggccttgtgcttttctttgactaagaagatgccaagtgaccttgtctgacttccagaaccagcacattgccctgaggatatcaggagaggaatctggtctaaccagctgagagacgagggcccgtggggtgaactgaggtgaagctggtactgactccttctaacaatacatccctccccactcacatggtctgtgagtttctaaggaaacctgaccagcgtcacagaatgtcaacgttacaaagacttcttcacagacaattcctttggaaaaaggtgttacagtgccacatgcataccttgagctcttctccagcacacgtcaggtgccagggctgggcactagatgcagctcttcatatagggagagatgacaggcttgtcaggcgttttggagcttcagtcatgaaaagcacacctggaatggaaaatgctccctcttgaattgtcctgatagatgttttgtttggccgtgttgcatggcctgtgggaccctgatctctgatcaggaatttcatgtgggcccttggcagtgggagcacacagtcctaaccattggactgccagagaattcccagggacagcaaggttttattattagggtgaatgaaatgtcccctgtgaactgtccccactctgtaattccaatttgacttaattctgcactttggagaccatgatgaggtcagaggaaggtcaggtctggagtttcaatcagcattgaaccttttatgtctaaggattctgtcaacatggaatccagagcttagagaagaaaggagaacatcataaggtaaaggcattttataccatctgagcaatttaagtctttatctaggccagaaagaagtatgtatctgaggaaaataagagtatgatggtggcttatagtggttaagaatttggcctttggtgtcaaacactgaaattcaaattccgctttttaccttgtagcagttacatactactgtgtaacaaatcacccactgttttttaatgacttgaattaggaaccatgcatttgttcagaattccagagtttggactggtatgtatctgttaatcccaaactcctaattcgtttatcccacccccacattccctttgttaaccataaacttgttttctatgtctgtgagtctgttttataaataaattcatttgtattattgtttagattccacatatatatgataccaaataatatttgtttttctcttcctgccttactttactcagtatgataatctctaggtccatccgtgttgctgcaaatttcaatattttattctttttggtagctgagtaatattccatatatatatatatatatatatatatcacgtcttatccattcatctgttgatagatacttaggttgcttccaagtctcggctattgtaaatagtgttgctatgaatgtagaggtgcatgtatctttccaaattgagttttcatcttttccagatatatgctcaggagtgggattgctggatctctacttggtaactctacttttagttttttaaggaacctccatactgtttttcataatggctgcaccaatttacattcccaccaactgtgtaggagagttcctttttgttctcacctttcccagcatttatttgtagactttttgatgatggccattctgactggtgtgaagtgatacctcattgtggttttgattttcttttccctaataattagagaataatttcctgtgcctcttggccatttgtatgtcttctttggagagatgtctatttaggtcttctgcccaatgtttgattgtgtgtgtgtgtgtgtgttttaatatttagttatataagctgtttgtatactttggaaattaagcccttgttggtcttagcatttccaaatattttatcctagtacataggttgtctttttgttttgtttatgatttcctttgctgtgcaaaagcttttaaggttgattagctcccatttgtttgtttttgctttaatttcttttgccttggagactgataaggcaagaagataatgctatgatttatgtccgagaatgttttgcctatgtcctctcccaggaattttatggtgccatgcttatatttgggtctttaaatcattttgagtttattctcgtatattgtgtgagggagtgttctaacttcattgatttacatgcagctgtccagctgtcccaacaccatttgctgaagagagtgtcttttctccattgtatgtttcttcctcttttgtcaaagaataatcgactattaggcatatgagtgtatttctgggctccctattgtgttacatttatccatatgtctgtttttacgccaatgctgcccaatgcggttttgattattgtaactttttagtattgtcttgggtctgagagatttatgcctccaaccttgttcttttgcctcaggattgctttagcaattctgggtcttctgtggtttcttataaattttaggcttatttgctctagttctgtggaaaatgtcatggataatttgatagggatcacactaaatctgttgattgatttgggtagtgtgaccattttaacaatgttagttcttccagtccctggagctttcctagcaactccaaaccagctgcacgtatcctgccaggtcagacgtggggccacatccttagatgttcaccccaaagtggctcattttttcattcctcaggaatgatgtgcttatgagcacagattttggagccaagtggcttgggcccttaccctggttcatctattgccttctgactctgtgattgggatccagctgcttctctataaaacgggactagtggggacttccctggcggtccatgggttaagattctgtactttcagtgcagatggtggacgttcaattcctggtcaaggaactaaaatcccatgtgtcacaggatatgggcaaaaatgaaaatttaaagggacttcactggtgaccctgtgattaagaatttaccttgcagtgcaagggacgtgggttccatctctcatccgggaactaagatccccgcatgctatggagcaagtaaacccgcatgccacaactagagagtccttgcgccaaagggaaagatccagcacgatgcagcaaagatcccaagtgccgcaactaagacccaatgcagtcaaatgaataagtaaataaacattttattaaataaaaaataaaacgagagtaatgatacctacctcatgggttatcccaaaggttaatgtgctaatacacctgccacccccggatcagtgcctggcacagcatttgagtttgccctgttgttattacttgggctccgtagcatttgctgctataaatgaacccctctttttggtcctcttcattatgtggcactaataatggctgctgctttaattattattgttcttgtccattcattcaatctttccctttttcttccttttttcaaacatcgcctgtatggctgccacatattagtcactgtgctagacacaggggacaaaaaaaaaaagaaaaaaatcagctcagctatggtctttgtcctcatgaagacagtccagtgaactttaaaaaccctaataggaataaagtgcaagaagtgtgataaatgctttggtaagtgcagtacgattctacaggagcccagagtggaagcaactactgtaactttgtgtgtgtgtattctggaatgctgttacaacaaattatgttgggataactaggccattacctggggcttacaaatattttggcggcacttcacttgaaatttgactgtaactggatttgacttgtatttagtggctccatttcctcagggttgaaaaagaggtcacatctctctggaatgagacttgacagctagtagcatttctcctcggtgaattgcttatcgggagggaagaccaccacatgccactgtgtacaggataaggtggtatgttacagctaggctggtggaccaagttgttccagtaatggagttttaaaaaaatttaatctgtatctctatgaaagaaatccatggacctagtttataaaaagtcaaacagtatttaaaaactttattgaaaacagcagtcccttaacccatgccttctcttctatttaatctctccttctctgagggaaacactgcaaggtctttaaagatgtttctcatggttcacctctgtgtttctaaataatatacgtatattgctttttcttgatttctttattttggatgtttttgttccccatccctcccccagtagtcactcacttctttgcctccccagccttctaatttatatatacagctatgtaacagtatttagggttagtatttttttgaccattgtagatacactcacagcgtaaccacagagatgactgtgattacttgttccttctcatacagagtttttattttcctagagttagtaattggcttattttaaaatttccttagctttctatgtgcttaccattaattcactagtggtctctatcagagcttaaagtttttggaatagtggcacacgaaggggacgctgggctggatgaagcacaagctggaatcgagattgctgggagaaataccaacaacctcagatatgcagatgacaccacccttatggcagaaagtgaagaagaactaaagagcctctggataaaagtgaaagaggagagtgaaaaagttggcttaaagttcaatattcggaaaattaagatcatggcatctggtcctatcacttcatgggaaatagatggggaaacagtggaaaccgtggcagactttatttttggggcctccaaaatcactccagatggtgattgcagccatgaaattaaaagatgcttactctttggaaggaaagttatgaccaacctagacagcatattaaaaagcagagacattactttgtcaacaaaggtctgtctagtcaaggctatggtttttacagtagtcatgtatggaattgagagttgaactataaagaaagctgagcactgaagaattgatgcttttgaactgtggtgttggagaagactcttgagagtcccttggactgcaaggagatccaaccagtctatcctaaaggaaatcagtcctgggtgttcattggaaggactgatgctaaagctgaaacttcagtattttggccacctgatgtgaagagctgattcatttgaaaagaccctgatgctgggaaagattgaaggcaggaggagaaggggacgactgaagatgagatggttggatggcatcaccaactcaatggacatgagtttgtgtaaactccaggagttggtgatagacagggaggcctggcgtgctgcagttcatggggttgcagagtcaggcacgactgagccagtgaactgaactgaagctccatttttaacttagataaacttactcatgaatcatttttggacttgtatccagaaagacctgaaactggcctccaagaacaattctgccacgtccctttacactcatcacaggatttcccttccttaaccccatgagtgtgcccctcaactctttcccacgttggatcctttatttctttgacttcacatggtcttcctttaaaaaaactacttccctgttttgatagagcatcttagtaggtagagtccatgaatgtcagaaaataacttgattctaccaccaacttgattgctagattagtttgtgatgtttaattttacatgtcagcttgtctggactaagggatgcccagatacctgtttaaaacattatttctgggtgtgtctgtgagggcgtttctggatgaggttagcctttgattcaatagactgagtaaaaaagatctacccacgcccactcaaataggacaaaaaagtgaaggaaaggcaactcctctctttcatcttgagctggactatctatcttctcttatctttagacatcaaagctcctggttctcatgccttcaaattctggcacttattccagtggccactcaattcccaggccttcagcttcagactgaattataccgctggcttttctggctattcagcttgcagatggcagactgtgggacttctgagactctgtaactgcaagagtaaatttcctcttatgtcggtatcatctgtagccatatcctctacatctattaatatttttggttgtgtttttctggataactctaacatagctgggtataaaattttagtttacaaataactttcactcagttttaaaaacattgttccgttcttttccagatttctatttttatgattggaaagtcaaacactgttctaattccaaatcctcatatatggcctattttttttatccttggaatttttaggatattttcctgtgccagctctcctaaaatctttttctttctttgtgagagagattcaaattagccctttcaatctggagacaaatgctttcagttggaaatttttcttctgtatttattctttgatagcatccttgcctattcttttttctttttatctaaaactcctattattcaatgttggcacacacagactaactcatagatttttcatcattgtctccttcctattttacgttctttgtgccttatctctgggtaatcattcaaactttatcttttaatctttttgattttttaaattttctgttaatgaaaaaaagctcttattctcatactttgaattaccaagagttctttctcattctatacattctacaaatatttcctgtttttcttagcctcagccttttgttttattacataatactttttcattttttctgagcagaatttaaaattttttatttaaaaatttccctctgtttcttgtcactttctgtctcctttgagttcttcttgtcaattgttttgttctgtccttcatgccagttttccctcagatgcctggtgacaccctggttttccattcctaatcaaaagtgaagcaaagggatttacttttggggtgataaaatgtttggaaattagatagaagttctggctgtacaatattatgaatgtatgaactgccactgaattgttcagtttagaatggtttaaaaataaaaagatagagaggcagtacagtttctctggtgaggaatcttcaatctcctgcctgggtaggggaataagcctggatacctatgtctgggaattcaaaagaggggaaaagacatgtcaattttcacctaatctccttttccttgctgggcctgtcaccctactcctgacatctctgaggtcaaaggcacttggttcaacctctccagagcatgaactctggtgcagttcattgctggctttgagggggacactcctctggctgtgtcagcctgagagcttttccttctgctgatcctgagtttggtcccgtccacatccctgctgtcctgggtttgtgggtctccaaatcttgagatgttctaaatttctgcttccttcctgatactcagctgtctggagccaacctccagacacaggtttcttcactctgctggcagcacaaagatgccatctttttggcttaagatgttcccctgggaggttgctactgaagcttcattctctgaaggagggcagtgtggagagatgcctgcacacggaataggggttgagagttttaggatctagtcttccctttggtgctaactggctgttctcacttgaatacgttaaggggctgctctgcattccagtttcgtgactatttcctgatctgtccaacagtgggttgaaggcagatgcctttgccagtcctcaaagccagtgcttggccagaggactttggaagatcaagtgtcagcccctttgggagttgagaatgaccaggagtccctttgaaaccccgagctgtcatttgaccccgtcggtacctttggagcaacattttcagctaaaggtataaagcgcattaaaaagtaagagaatacttgaaatgcaagataatccccagggatagaactgttgaatagaacaggtgactagagcttagcctgttagctgaaatggatatactttaaattttcatgtataaaggatggctattagtttggccttacagtcctcgactcaatgacccttctgcttccttagatcaaattctggttctttctggcttcatactgactttccaaactgcagttgaaacaggaatatcagcagaactcatgctagaatgtctcatcaatacaatagaaaagccaatacaagccaatgacacagaacaaattttaatattctaaaaagatttttttaaaacagcctcatttatatacagaaacctctggaggggagcaggctaaaaggatacagaaggaaacacaggcagttatgtaggatctcctttcaaacattgttttaaagtgcagagccctttaaagctgtgttcagaatctaggctacttctgaaagtctgccgttaattttagaaaataagaacggaggcaagttcgtgtggttttggtttcttaagtcttgagagaagtttccctttcacttgtgcacctcaaatgattcccttctcatttttcactcccccttgcttgtctggacccgtctttctcattgcctccagcttccttctctccttaaagcccccatcctgttttctctctctccctgtttccccaaacactgctgagactctgccccaagcttgggggctgtgaaatttgtgcagacttccctgctctgactgccctttcctttagcctgtggcctctcctgcttcctgccaggacaacctcttagccctctccagggagcctctgaatcaatccctttggattcctgatgtttatcttccaagttgaaaagttcaattgcagcccagagtggggccttggaggctgagcaggggaaggtgactgcgatagatttccctccaaccagcatgatgccattcaatgcccaccaaggagccactcagggttcaacaccctcaaggctgtgcccactgatgattaaccagctgtgagagctgccagcttgctctggtctgctcatttcttctctgaaatctaattttcatctcactgtgtttttgcctctcacttttttttctctttagtgcaaattcttcaaccctatatgtcttttttaactgaaaagtgtcgtgagagagcaggtggtgagaaagaggctcacaaggtaacactgcattgttctacttgcctcccagcaaaaccattgtgttcaggctctgccctactggaagtggcctttctgaaaggtgacaggggaaattcagtttcctttgatatgttaaatcgagtctgtctttttgcctccttgacaaaagagtgggcttaagaacttgctttttaaattttatttactttttaaatttttgattggaggataattgctttacaatgttgtactggtttctgctatacaatgagaatcagctgtaagtatacatttatcccctccctcttgagcctccttaccacactacctctccccgtcaagagcttgtttttttaaaaaaagaagcatattttaaaatatgtgctgtgctgtgcttagttgctcagttgggtctgactctgcaaccccatggaccatggcctgccaggctcctctgtccatagggattctgcaggcaagaatactggagtgggttgccatgccctcctcaggggatcttcccaacccagggatcaaacctgcatctcctgggtctcatgcagcttctgcccttgcaggcaaaatctttatccctgagccaatggggaagcccctttggggcagcagctgctgctgcagctgctgctaagtcgcttcagtcgtgtccgactctgtgtgaccctatagacagcagcccactaggctcctctgtccctgggattctccaggcaagaatactggagtgggttgccactggggcagctagtttacttttattcttattaaaaaaaatttttttttttttttttttactgaagtacagttgatttacaatgttgtgctactttctgctgtgcagcaaagtgactcagttatatgcatttctttttgatgttcttttccattatggtttatcccaggagattggttatagttccctgtgctatacagtaggaccttgtttatccattctgaatttagtagttggcatctactaaccccaaactcccagtcccttcctctcccttcctacctttcccttgctaatcacaaatcttctctgtgagcctgtttctgttttgtagaatatacatataagtaatatcatatggcatttgtctttctctttctgacttgcttcnnnnnnnnnnnnnnnnnnnnnnnnnnnnnnnnnnnnnnnnnnnnnnnnnntggattctttactgtctaagccaccagggaagcccattttcaaacatactcatagtccaaagaaatggcaacccactccagtattcttgcctgaagaatcccacggacagaggagcctggcaggccatggtccatgggatcgcagagattcggacatgactgaatcaactaaccgcgcatagtccaaaggaccccgaagtgactgtcaaaagtgatccgaaatcctgagcccaggagagaaataggagaccccagctggggtccccaggaagaggtcacacggcatcctgaggtcctgtggttcaggtggggaagcacttgggaagccaacggatccgcagatgtttcccggctgatttactgtgcaattttgaaccatcagcctctgctccactgtttccttatgtgcaaaatcagcaagtataaaataaaatacattcagagatgacttttcatggcatctgtgtcgcgaggaagcagtgttctgcactatataccatcacacctaggcaaggtaagattggctggaaagtcagttgctgggctggtttctaaggatgtgggtgctttggtttctccatttactcaacttttactatcagcctttcccaaacaaccaagttggaagacttttgatatttgtatgtgttgcgggagaatggggcatgagagatggtcatgtcccaggtcttgagcttccctaggggctcaaatggtaaagaatctgcctgcaatgcaggagatataggtttgatccctgggtcaagaagatcccctggagaaggaaatggcaacccactccagtgttcttgcctaggaaatcccatggacagacaagcctggcagactccggtccattgcattgcaaagagttggacacaactgagtaattaacacacacacaccacacacacacacacacacacaggtgttgcaggagaacagggcatgagaggatggtcatgtcccaggtctccagctagtgtctgggatgggctgccaagaaatgtccttggcttcacgcaggaaagaattcaagagggagccatagtaaagtgaaagcaggttcatttgagagagatacacatttcatagagagaaggcagtccatctgagaaggtgacagtggccttaaaacatggaatggttagtttctatgggctcggtaatttcacagataaaaagcaggaggattattccaactattttggagggaggggtggagatttccaggaactgggccaccttccactttttgatctttgatggtggccttggaactggcatggtgctggtcagtgggtatgtgatttagcatatgctaatatattataatgaatgtataatgaagctcaaagtctgtatgtatgtatgtgtgtatgctcagccgctaagttgtgtccaactcttggtgaccccataggctgtagcctgccaagctcctctgtccatggtattttctaggcaggattcctgaagcgggtcaccatttcttacaccaagggatcttccctacccaggaagtgaacctgcactcttgaccctcctgcattggcagacaaattctttaccactgcgccacctgggaagccctggctcaggatctcaagtcaaatcttccacgattttgagcctaatcagttctaaccagtttttgtcctactctgttcttaagggctgtgtctttcttttaaaagttatgccctgcccccttcccacgtgtctcatatggacaaagattttctcctcaactaatccctactcatgttcttttgaactcttcaactaggccttgacttttgaacgttcatatttgcctctgttttgtccagtgttagcaagaatcccactacgtcagtttaaccagaatcccccacctttgttatttgacgctcatcctccgtgatcccccaggtgacgtctggtcaccctcacctgccttcagcaagaatcctgcttggttgatttagcaagaatcccctcttgttcttcatgtttcctctcagtcattttctattcactgacccccctccctgctccttggctctgaaatcccattaacccaggtggttattcagagatgagtccagtttctccccagtgctgtggtcctacacctatgggcatccacccccttgaattaagtctacagtgctttcacaaatatcattgaataatttgttctttagcggtaatttttatttcaatgattcttttgatacttgtaacatcaacctgtgacttatctgttattactattattgttgcttcatagaggaaaaaccagacctcagacaggttagatgactcacccaacatcagaagaatcaagtctttggattcccaaaccaatattcttgcttttcaccagaggccaaaatgagtggcctctctagtttaaagaattcttggagcagaaagtgtcagtgtcagggctgagtatggggtacaatttcaatgaattcttactccctaccccaatacacagcagctgttttatctgctaaaacaggaaagtgccaacccttgttatgtaatagcaggtgcatttcccaagaagatcgctatcctagcagcatcgaagctttgaaaagtacactgggaatggtctgctggatattttgggccagatctccaccaggggaaataatcagagtgatttgaaagagcttttttaagcccaccaagtcccgtgatgaggggtgcgtcatcagaggcgccactctcttctcaaaggctgtctctccaaggctcccaatgccgtcagcacatctcagcctcattgccactgggccaaaccaggagctagagaacattcttgaagaaaggaatttgaaaggagcccagacaccctatcgtggagtcaacaagctcaaaaaaaaaaaaaaaaaaaaggaaaagaagagaattagtagccctcatctctgctctgctgggattgctaggaagctgtcatttcaatggtcaatggcagtgtgttcgagatgagtgctgttctttacaaactgattgaacaaggatgttagagaggaatcctgggggcaagaaagcaggaatcacgtgtaacttaggcccaatttctggaccaattattaactacttgtgtgaccttggagaagacactgttcctctcttgtgctcagtttcctcatctgtacaaagaagtcgttgggcaaggtgatcccagggtttttaagccgcataatcatctgatgttctttaatcctcagctttctgcctctgagccgtgaggtgaagggtcggggttaagactgcatctatcagtttgggcagagacagtgcctaccagctccctgtccccaaaggtacgaaaggaccaatgatgtctctgcccccacacagcgcacattcagatgaggagctacagtgcagagcccatcatgcacattgtctgagttattaaggtaagcaacccagttttctccaggctcctgaggggtctgacactgatacaggcatgtgggaaaggcacattctttgaccaactggaagaggtagggtgagcctccagcagctggccacactcagaaccagacaagcttctcagtgcaagtttttgatcaatctctgaagtaatgattctgtttgtggttgtggggttttttttccactctttctctcccttcctccctttatccatccatccatcctccaactatccatcatctgtcatccacctgaaacaagaggaatcaatcaagtttaaaatcaacctttaaaagaatcctaggggattgttgaggggcttccctggtggctcagatggtaaagcatctgcctgcaatgtgggagactcaggttcgatccttgggtcgggaagatcctctggagaaggaaatggcaacccattccagtactcttgcctggaaaattccatggatggaggagcctggtaggctacggtccatggggttgcaaagagttggacacgactgagcaacttcattttatttctttctttctatagccattgaggatatgacataaactggccagaacccataggtccgagatggtggaagatttgacttccagttgaccttgagcttcactgtatgctcactgtaatgcatcggcatgctaaacgacacacccacaggtgccatgacagttcctaggctgaccataaaagggcaaaagtgggcagtggcccagttcctggaaatctccacccctccccccaaatacttttaataatcctcccactcattagcctatgaaattatcctatccataatactaaccaccacccccaacccatattttgggatctcttaccttctgagatggcccacactatttccatggagtgtgtgcgcctctcccatggccagtctcatctttcgagatggactgcattctgtatctggaatgtgcatctctccacataaatccacttcttacctatcactttgtcactcactgcgatgagacataaagaatctgagtttctgaatctgaattcagtcctaagaccaggtgtgtgatctcaatgaaaagacagtgggttcaagtcccaatctgagttgtgcactttcacatccatccatcatccctttatcagccatccatcctccatttatatatctattattctctaaaagtatttacccagcacgcaacttggttcacagggctacgacaggccctgtgtgagatacaagggacatgctgaagatgagagccgtcttttgatttggaaagacaaactcgagaagcaaagatattgcagctagaatggtaagtgcagaggaggagtacaagggagacggggagccctccctacccctgcccacccctgcccacctctcccctccatccctttcattcacctgtggggattccttgatggctcggcggtaaagaatccacctgcaatgcaggagatgtgggtttggtccctggactgggcagatcccctggagaaggaaatggcagcccactccagtgttcttgcctggagaattccatggacagaggagcctggctgcagtccctggggtcacaaagaatcagatacaactgagcagcatgtagcaggccgattcctgtcaaacaccttccttagctgaaagtaactatgtggtcacattcacacagctgagacaagagttgtatggagccacttcacaaaggcttcctgagcaaacggaattattattgcagctgggctctgctgctcaaccagagggatgttgctgtggttcccaggccctgactcagtttcctcagagcacgctaataataatgatacattagatgtgtcttcttttggacggagagtgttaggatgattcccatttaacttgtcatcttatcattaactgtaatactataaatgaatggttaggaggataagtacttactgtgattctactccgaccatctcacatttagtgggatggtggaaaattggcattagtcaaaaactgtgatcagtgtggggagaagagcacgctctagaccatccatcatgtcaacaattgcagatggttagtatggggaagaaactccacaataaaggggctctcactgcagaaggaggatgtttgtcatgggttcacctagaaggtcaaagctaagacagggttctaaggcagaattagctcaacagaatttcagctcaacatgaggaactactttttgaaacaaccaaaatgtccactgagtgcgaaatggataaacaagatgggcacaagaaatattattcagtaatgaaaagaaacaaagctctgacacctgctacaacaagaatgaacctcggaagcctgacgcctagtgagagaagccagtcacagaaggccacatgccgcgtgatttcatttatatggcatgcctgggacaggcaagtccattcagacagaaagcagatcagtgcttgcctagggctgggtggttggagggaaatgggaataacgggtacaggtttttggggggagggtgatggaaatgctctaaaatctttcaaggtggtggttgcacaactctgtgaatatatgaaaaaccactgagttgtacactttaaatgggtgaatgatatagtacgtaaatatatccccaaaagctgtaataaaagttaattggcttgtttttaacttaaaaaaaaaaaaaaaaaaagacttccctggtggctcagatggtaaagcgtctgcctacaatgcgagagaccagggttcaatccctgggttgggaagctctcctggagaaggaaatggcaacccactccagtattcttgcctggaaaatcccatgggtggaagagcctggtaggctacggtccatggggttgcagagagtccggacacaactgagcgacttcactttcactttaacttaaaaaaagaaaaagaaagaaagaaactgctttttaacaaggagagtgaaagaattcacaagcactgtccttaacccgtgttaagccctggataccactgccccctgccccagttcacttctgtttgttcatcttgttcaacagtgagaagactttgctaaaacaaccagaaccccgtcatctctggagacactagcaaatcctgagtgaccatctggatatgaagaatgtccctgcagtgagagaggtgggtcttggtttagagtttcttggaacttgcatctggattttgaacttcgggcaggtcgttttgatttaggaggtgatctcagaagccacttagaggaaggtgtgtccacctcccaccttcctgtctggacctgtgtgggagacaaggtggccaccacaagcccccaggggttcaaggtgagaagctgtggacagcgagtgtggagtgcgatggcagagtaaggtgagcctgggctcacacagaacctttccctacagccgagactgcactgggctggatgaagcacagctggaattaagattgccgggagaaatatcaataacctcaggtatgcagatgacaccaccctttggcagaaagcgaagaactaaagagcctcttgatgaaagtgaaagaggagagtgaaaaagttggcttaaaagtcaacgtccagaaaactaagatcatggcatctggtcccatcacttcatggcaaatagagaaacagtgagagattttattttttctgggctccaaaatcactgcagatggtgactgcagccatgaaattaaaagacacttgctccttggaaggaaagttataaccaacctagatagcatattaaaaagcagagacaccactttgctgataaacgtccacatggtcaaagctatggtttttccagtagtcgtgtatggatgtgggagttggaccatacagaaagctgagtgttgaagaattgatgcttttgaactgtggtgttggaaaagactcttgagaatcccttggactgcaaggacatcccaccagtccttcctaaaggaaattagtcatgaatattcattggaaggatggattggaaggacagatccaatcctttggccacttgatgtgaagagctgactcattggaaaagaccctgatgctgggaaaggttgagggcaggaggagaaggggacgacaaaggatgagatggttggatggcatcactgactcaatggacataggtttgagtcaactctaggagttggtgacggacagggaggcctggcgtgctgcagtccacggagttgcaaagagtcggacacgactgagcgactgaactgaactgaactgaactgggactgcactcagaggagactcaaggatgactcccgttgttacaggcacccgacacatccaccacaaaggacagttttggttcacaccagcaacggaatggatacgactctattttattttattggagtagaattgacttacaatgttgtgttagtttcaggtgtacagcaaagagactcagttatacatgtacatatattcattcttttctaaaagtcttttctcgtttggtcatcacagaatactgtgtagagctctctgtgctgctatacagtagggccttgttgactacctatcttatatatagtagtgtgtgtgtgttcaccccaagctcctgctttacccctcccctccacgtttcccctttggtaaccataagtttgttctctataagtttgtttctgttttgtgaatcagttcatttgtatcatgttttttaaaaaatctaattccacatgtgaatgatatcatatgacatttgtctttctctttctgacttacttcgttagtatgggaatctctaggttcactcatgttgctgcaaatgacattatatcattcttttttatggctgagtaatattccatagttatatatgtatatatctcacatctttatccattcctttgttgatgggcatttaggttgcttccacgtcctggctgttgtaaacagtactgcaatgaacattgcattcatgtatctttttgaattatgttttttctcaagatatatacccagcagtgggattgctgggtcacacagtagttctatttttagttttttaaggaactgccatattgttctccatagtatttgtaccaattaacattcccactaacagtgtaggagggttccctcttcagatatgactttttctagtggagtacaataaaaatgttcgaatgggatgacatctagaaaataacatttcgggaattttttgtcttgttccttgctaattgtgtctgtgtgcatgtgaaagtattgagtcgcaacattaggtgtaggctgttcgtttctagggccacagtgaaaaatactgctcagctaatccctaagttctttcagaaagagaagttcattttttaaataagtttttaggttgttgtggagaaaactgaagactgtatgtcttgttggaaagagcaggaatgaagtatgtgccaagggagatctgggctcccattgtctctgtttcttagggatgatggatctggggcacttgcctgaagtaaagagatttaaagaactggctcagaactgtgggggtcagcaagtctgaaagctgtagggaagaccactaggctggaagctcaggcagcattgctgtgttacagtcttcaggctgattttcttcttccttgggaaattcagtttttgctcttaaggccttcaactgattagatgtggcccacctgcatcatggagggtcaccttcctgtgactacatctacaaaatgccttcacagaaacaccaaaattagagtgtggttaaatcaccatgtgtacagcccagccaagtggacaccagggggaaccatcatacctgacgtgcaggggtttagacaaggaccagtctcaattccttagtcctggtgctccttgcaggtcagcacataatccgacagtcttaacatcaaacgccttaaggagaatagaatttgcagcctgaagcttgtgctatgttatcagaaattctagacattttttttttttctggctgggctgcacaaggcatccagatgttagctcttcaaccaggcatccaatccatgccccctgcagtggaagcagaatcctaatcacttcatctccatggaagttccagaaattctagagtgtttgagctcatctctgttcccagctttacagccaagaggacccagacacacagagtttatcccaggtgcagaagacctcccatgaacgtgtggccaaacccctacccagggacacagcttgtctttcttacagacagtgatgggttccaaaatgatagttggccctggccaaggtgggcggcaggtggggaggaggaaatggtgtgttttaacagaatctcagcttcactgagactggttcccattctcctgaacaaggggatggttgtgttttcatttgacggtgaacattattgagagcacgtttcctgtggagaacagacccgcttcccttccttgcggggggaggaggtagaaaggggggcgcagctgttctgggaaactcaacccactccctcatggatgggcgttaagtcatcagaaccagatgtgcctggggtctggctctctctacctcgccacagggtgaccaggcccagaaggcggggctgcagctacaggaaggctcttcggggtgttgggtgcctgggatccctcggtgtagggtggggagggggctctgtggcaggagatgcgttggcctttctctcatcctcccccctgctttttctttgccaatgtgggagccaccagactgactcaggggccccaggtccccgtgtgtcccagcttgtcccaactgagtctcagcaaggctcaaatcggtcaaggccccgacctctcctcaggggcttgcaaaaagcttagcttaagctgcacttttatctgtttaatatactgcagatctgggtaaaatttcaaatgataaaataacaaattccactgatgatatttttaaaaaatctgaaaagaattgccagagataatgggaaattatttaaggggatcctctaagatatgatgagtgtaatataatgttaaaacataaaacacaaacacactattgatactacgtataaaattgataactaatgagaacatactgtattgcacagaactctacttaatacactgtggtgacctgagtgggaaggaaatccaaaaaaacagaggacatgtgtatgtatagcggagtcactttgctgcacggtagaaactaacataaccttgtaaacataactaaacatatctacattccaataaaaactgatgtagaaaaacataaagggggaaatggggcgtcacgagtggctcagtggtaaagaatctgcacaccactgcaagagacacaggagatgcaggttcaattcctgggtcaggaagatcccctagaggaggaaatggcaacctgctccagtattcttgcctggagaatcccatggactgaggagctggcagactataatccatggggttgcaaagagctggacatgactgagggactgggcaaagggaaaatgactaaatcacatatgacatttcaaagtctttttttttttcaatacccttatttatgtacgagtgaaagagtcgaacatccctgtatacagtcagaaattattgaagacataaaggtgtatgtgacacaggcaaaacacatcttacttgcacaaagttaggaggggacccagaagtccagtctaacatatacaggcatcggagacacgagtgagttagggtacacggcacttcttattcaaggggcggggctgcgcccaggtcatacctgaacggacagtgagcctgcctgatccagcagacccagctgaatcctggtttaacccccaaaggacaatcatctcccaagtttctcatttcaccctcagagaacagaacacatccagccaggaatacaatccacctttcagatgggagaaaccttacataaacctcaaattacctctagggtcttatttttcctcatgtgtacataattaaacaaaatttaaaaaaagttattgcttggccttgtgggaaaaataaacaccttctggaatgaaaagggcccagtgtgatgctgacatttagttgtacttttgctcatgggaaatattagtttgttggtttagtcactaagttgtgtctgactcttgcaaccctatggtctttagcccaccaggctcctctgtctgtggaattttccaggcaagaatactggagtgggttgccatttcctattccccacccagtcatggtaccctagtctcttattttgcaggagggtgattcagcggtaaagaatctacctgccaatgcaagagacataggttcaatccctaggtggggaagatcccctggtgtaggaaaaggcaacccactccagtatttcttgtctggaaaatcccatggacagaggagcctggcaggctacagcccttggggtcgcacagagtcagagaggacttaccgactgagcacgcagtactagttacttatgttacagccaagttgattcagagaagtcatttcagtgtttctgtggaatcaaaagatgccatgaccacctgaccttctgggctaggattggccttttttttttatgtcagtagggatcatggtaaagacgtgtatgcctcagcatggaggctgacgccaagagcatgaggattcagtgaggccagggctgggatggggcacccttgtgacagctggtggcgcaggagcttatcctgggctctggacgtccaagagccgcagcaccaaggagccaagcatgacatctcatttcacagagtcctgctgggtggacttgtggattttctctcatcatcctctctccaaaacatggcgcctccttcaatcatacccattccggaccccaggatggaggaatgttcttgtcttggccttgatctgggtcttctctattgggcatttgacatctgttgggacatttgttcttcagtcactcagtcatgtctgactctttgcgaccccatggactgcagcacgtcaggcttccctgtcctttaccatctcccagagcttgctcaaactcatgaccacagagtgggtgatgtcatccaaacatctcatcctctgttgtccctgtctcctcctgccttcaatcttccccagcatcagggtctgttgtgaccgggtggagtggtggcagggctgggggtgggcggtaactttaaccccgtacttgattcagatttcctagtctcccaaactttctcagcttcggctttcactagcgaaacccgaccattcatatggagtgtgtctgagcctgagaatcggcattgccttctgcaaaaaggcagacgtgtgtcctgctgggccccctgactctggggactgatgtggggctgggtgaggagcaaggtgaaggaaggggactggaaggagtgcccaccagagccacatgcactgtgatgaggactttaaaactgattccaagtaagagaggaggcactggggcattttgaacaggagggtgacaggactatttggggataatttctagttttaaaggctttctttgcttgtagcagacaaaagcagaaagatgggcaccagcagggaggccacggcggtagcctaagcaatagggtcggggtgggcaaggcgaggaaggggtgaggatggaaggggcgaaagatgagacagacagagtagatgagacttggtcctgcagcagccagatcctcttaatactcaacctggcagttaagggttaattcttattctattggaaggcattctcttgggccttcctagaaggcaggcagtgacccggtgctgcctgcgtcaggcagagtggggaggatttatgcacggaagaactgaggcttctcctcgacctcccttaaattagtcaccatcagtcagccggcagcctgaactcttgagcccctttcagggaggcctgcctgttgctgagaagaggagagaagaatctggcctcggttcaagaggaccaatgtagggaagacggaaaagaaacaagacaaagctcatcgccatatgaaatgcagcattcagagagcacagctcctaaccgtgcacctccgctcatccagtctccaaatgaagggcgtgctgtgcttagcttttaacgggtgacatgtttccactggagacattgatcaccatgtgttgaggtttataaggtcagtggttttggtggaaaagggttttgtttcttttcccccaagcgatgggaaaatgtttcaatagaagacagagcacgaggatgaaactttatttggtttttggcattgaggagagagtcacagagagtaaagctgttatggaattgctttaaggtcttgcctgttaagcctaaaaatagtgtatcactagcaaaacaactgtgcaagatgcaaaattcctgggtaacatttaaggaggctttcaattacaagaatcagggctttattatcttatatatcaagaggttggaggttggcatgtgcacagttgctaaattcatcagtttatggacatcagggctctgtgcctgctcactgagattttctaggtttttgcctcatggtcacaaggcggctgccagcactctatgcactgtatttttatatcatggtatccaaaagcataatgtgagaatggatacctctttgtgtgtctattttgatcagggaggaaatctttcccagacaaccctcacagacttactcctctcacctcactggcccaaactgggtcccataccaattcctaaatcattcctggcaagttatgatttgcctccgtaagactgggtacactggctttgagtgtattgcttcagtctctgaacaatatcctaagctgggtttcaaatatatctagcaacctgccatagttctgtagacagaatgttgtgtatcccctacccccaagtcatatgttgaagctctgcacatgtgatgatatgtgatgataccaggaaatggggcctttgggccataaaagtggcactctcatcatgggattagtgctgttgtaagaagaggccagagaatgctcttacattctctctgccatgtgaacacacagcagaaggcagctgtcttcaagccaggaagtgggccctcactaagaacctgaccgtgctgacaccctgatctcagacttccagcctcttaaccatgggaaatacgtttctctcattcaagccgcttagcctttgatatttttgttagagcagcccacactgaccaactcacgtagtttatactaactgagtaagtgggccgtgagctgtgggcccagtcattcactctgtgctttgtgcgcttcaccgtactctcctgtggtagaagaggggacttgcgggggctcaggggtaaagactccgcctgccagtgcagggggatgcaaattccacccctgctgagggaagattctcgcctgggaaatcccatggacagaggaggagtctggcaagctacagtccctggggtcgcaaagagtcagccacaacgtaatgactagaaaacagcaacatgggagagtggcgggggaggacaggttcaccagagacgtgtttttaaggagagtcttgggagatcgtgcccagagtaaaccagtgaaagactgttgttcagaggaaataagcaatctcgaatagagcctggcgtcttttggctcagtccctgttttctgaaacattttaaaacttcaggacccagataaggcttcttggctccctctctgaactgatagaaaagtgtgaaaattttgatggcttaaaccaatagaaatttatcctcacagttctagaggtcagctgtcctagatcaaagtgtggccaggattggactccattcagaagctcgcagggaggttctgttacctcctccagcttctcgtggccgccagcattcctggactcatggcttcatcattccgatctctgcctccatcttcacacgggcatcctttcctctgtctggtgaatgatacttgccatcaaattggggaccaatccatataattcaggatggtctcatctagagacccttaatttatttacctctgcaaagaccttttctccaaatcaggtcacattcatagcttctgaggattaggacatgaggtcgccatttttggaggtcaccgttcaacccatgggattccctggtggctcagtggtaaagaattcacctgcaatgcagaagatgtgggttgggatgataccctggagaaggaaatggcaatccactccagtattcttgcctgggaaatcccatggacagaggagcctggtgagctatggtccttagggtcataaagagtcagacacaacttagcaactaaaccaccaccaccacccttcaacccactataagcaatacaaggctcttttggttttatgtgacagaaccactacttgaactataataagttaaaggaaatttgtgagtttatgaaaatggaaaatataaaggaggttctaaggggtcaaatgatgtcagcagggttcttttctatctttcattccctttgtcagctctacttgactttattctttctgcaggcctttcccatggggctgtgaacatggcccctgcaagccccacattcataaccttgcagttaaagtcaacgataaggggtagctgttaagagtgctatagaaaattcccaaagaagactctcattggccgtgctgagtcacatgtccacttctacagcggaaggcatagggggaggaactttacaatgattgacgaccccactagaaccatatggtagagtggaagcataggtccttcaaggaagtgacgtggagcagacaaacaaaatctgtctactgaaggacattcttccccctccactacgtgaacgaggcatagctttcatctagatggttccatgcccctgcttttatgagacataagcagcagataacatattacattgcaaatttgcaccaggaaatggggtggcgtctgaagggggataactcactcatgaccccatgtaagaaagacacctaggtggagtccccaaaatactcgttgaagaaaagcttataggaaacaagagccagtacctgtatttacaggctggtaggacctggagataataactaaaagaaaagtcatgagtgtttgaaaattaggcaacacacttctaaataacacataggttcaggaagaaatcacaatggacattagaaaatattttgaactgaatgctaattaagttgtgacacattaaagcttgtgggaatgcagctaaaggcatacttgaaagtgaaagtgaagtcgctcagtcgtgtccgactctttgcgaccccatggactgtagcccaccaggctgctctgtccatgggattttccaggcaataatactggagtggattgccatttccttctccaggggatcttcccaacccagggactgaacctgggtctcctgcattgtagacagatgcttaaccatctgagccaccagggaagtcctaaggcatacttagcggggcattgatagctttaaatgcacatattggttggggtggtaggggggacctgaaaaaaatgaagtagacttaaagctcaaaaagttaggggcttagcctgaaggaaggaattactggcttctgtaactgaaaagtccaagtgaggttctgcttccagacacctaggtcaggatgtcaaaagctgagttagtagtgagcttgagttagtagctgcccgtttggtttcctagcttacctgcatgctgactgtattctcaagtaggttctcatcatgtgatgttcaggcattgcaggtttaagtcctccaagttgagcaggaggatagttcaagaggaataagaccgcagaagtatatgcctaccaattagaggtcgtgctaaggccagagtctacagtcatggctgagggtaaggaggtgtgtgtgctcagttgtgtcctactctttgcgatcccgtggcctgtagcccaccaggtccctctgtccttggaattctccaggcaagaatactggagtgggttgccatttcctcctccaggggatcttcctgaaccagagatccacatctcttatatctcctgcattggcaggttggttctttaccagtagcgtcaactgggaagaggaataaatagttctaagaagctccagcagagttttctcagttgattctgattcgcctgggttggaccacatccccacctccaaaccaatgaatgtagcctttggaatcctattggatttgaatatgaaactgatgatttgtggacattttaaaatttagtgatcactaggagtcagcacgtactcttaaaaaacaagccaatttcattaaaaaaatttttttaaaattttttgtttcatgccatgcggcatgtgggatctcagttccctgaatccatgcctcctgcagtggaagcacagagtcttaatcaccgaaccaccaggaaagccccccagtctcatttgtttttcttttgcttcttaattcaagagacttcttcttgcatgatttgatttcccttaggcattagacagactatcatgatatctttgtggtggataagatgaagtcttactcaatgcatttaaatcggattcagttaaccagctggttgaccaaagataatcacgtcacagtcttcctaactattttccaagccatctgcttaaaatctgttgatgatcagtgtgacagcatgcttcttcaattgatgctcttctggagattctctttaatggataaccccgtgctttttttttttttctgcttctggcagaatttcttttcagtttttattccttggacagatgtgtaagagaatttttttcagttttgaagatgatatgaaataaaaagtgtaagataatgccattggtaaggcagcatgaggaatctgactagaatttgcagggatttagatgaggttaagcagtaattaatacaaaagcctgcatttaggttaaaaaaaatcctcctgtccaagtttagaaggtgaggaaaacataactggcaggagcttatgtgcaaagtccagatcaaagtcggccacaggacaaggagaatgaacgcagcccacacgtcgagagaccagaccacagtcagggctgtctaaccaccaggcctcctgctgctggctccagttctaacagtgggttcacttcctggggccttatttcaaggcgggtattgaccatcttgcggactttccaggtggcactagtggtaaggaacccacctgccaatgcaggagacttaagagacatggggtcaatccctgggtcaggaagatcccctggaggagggtacagcaccctactccagtatttttgcctggagaatcccatggacagaggagcctggcaggctacagtccatggggtcgcagagagttggacacgaccgcaaggactcagcatgcacgcatgcacactgaccaccttgagagctctccagtcaaggcattctgatgagtgaggaattcggaatcatcctgtagaaatactggatggaggaactggctatatttctcccagggaattggagattttttaaaaagaacagctgctcttaaatatgaaagggttatcatgtggaggaggaagcagacttgtccttgctactccagaaaatgcagtaggagaatgagaggaatttttagagttgacccaggatgaaaatgttaattgctcagccatatttgattctatgtgaccccatggactgcagccctccaggctcctctgtccatggggattctttaggcaagaatactggagtgagtagccattcctttctccaggggatcttcccggcccagggatcaaacccaggtctcctgcactgcaggcagattctttaccatctgagccaccagggaagccctaactcaggatgagacacttcctaataactcaaattattttaaaaaatggagtaagcacccttttcccctgctggtgagctctagcagacgtggggggaccttcttcaggcagagacggtaggtatctgcctacagcatccaggcctccaggagttggattttggcttggcagggcaggttatctctctgagatccttatttatttgtttgtttgcatgcaatcagctgatgtccaagcgagtcctgctagggatggacctccgtgtggtgggatgggcagaggagcctggtgggctgcagtccttggggttgcaaaagagttgtacatgacttagtgactaaataacacaggacggtttgttcttacctggttccgcctctttctggctgtgtgacatcaacaaaattctgtaaagcaattatccttcaattaagaaataaataaataaataaaaagaaagcgtctcaacctccctgggcttcttttttcatccatgaaatgggaatgggaatgacaatcccacagggctgtgcaaggcaacgagtgtaaactaagtgaggtctgggcatcggtcacaatcactggttattaagcaaggcgctgcggacaagcaagagtgagtacttggcttcatgacactatttccccgcaagatgccaataaaaacaggttcagagagtcagagatcatgtttttaaaagctgcaagggggcctggatggccagaggacctgtagtaatagtaacagtaacaactcagcagcaggaattgactatgtcgcaggccctgggccaaacacttcacataacttattttgttgcaccctaacaggtctgtgaggggaggatgacaatggtgatgatcatcagcattatcattttacagataaagacagtgagcctcagtatataacttgttcacacagtaaaactcagattgaaaaaggtatctgcccacccaccatccataatctgcacccctgggcacatggcctttgagccactaaagactgcatttcattggaacctaaaggacccatgaggggaatctgagggtcttaatggaacgcaggactgaatgagccaagacggtgacacagttactataaaaaacacgtgtgatcatttccgacagtgtgatcagacggccacttctgggcgtgttctcctcgtcacctcgatgtcatctgccccacctaggcttggctctggatgtttgagcatagccacatttgggtggcctgagttaactagaaatttccattgtcctggaatgccttcaagcagagataaatgcttaaaggcattcctttaagaaatgttttcttcaagcagagacaaatccttgaaatgagaacacaataggtctggatataccttagcctaagctcacggatcctgggaacaacggccagcatcctttcctttccagtgtgtctgcttcttgtctgactgcctacagtgcaggggcggtgaggagacccagcttgggaggctggagccctgagggagtccagcctccaccctgggtcccgaggctgttggatgcaatccttcaagcctgtctctttctactggggacaaagttttactgcaagttccaggctgttctctgcgggtaatttattccaaatggaacagctgacaagagagagagagaatgggaaatgggattgacagcaagcaggcccaaaggccaggatcccaaacacacaatggaaatccaggagggtgggaaagctgcagtctagcatggaggagactggagccatgaggttggacatcctccacgggaaagtcagaggaaacacagggtgagaataagtgacttaagaaggcaagtacacatttattaaatttccttttaaaactttatctgtttatgtatttggctgcagcgtgcgatctttagttgcagcatgcaggactcagttccccgaccggggatcgagccccggcccctgcattgggagcatagagcccgagccactggaccacccgggcggcccgcaaaagcaagcatactgatgaagacttctaagtgacagaaagaatgctaatgataactaacgctgttgtgcgtttatggagtctggtgttatactccttcccagtctcattttccatagatattccagattactagcaggaaaaaaaaaaaaaaaagaggtaaaggatgaacaagctgtcaataggaagagtcagttttttctttctttttttttttttggctctgtggcttgtgggatcttagttccctgaccagcgattgaacctgggcccatggcggtcaaagtgcagagccctaaccactggaccaccagggaattgcctggaagaggtcagttcaagtctaactttcatacttttcagagaccaataataacctgttgatgaaaattaagcaatagtctatctatgaaacgagtggaaaattttcttggagccaaatttgaggattataacctgggaagagcgtcccaggaagctctgagaactgttgcgcctgttagaagtcaaaacagttatttaagtgtttttgaaacggagtactgtacattcaatgacgtgtaactgacagttgacacaatccagatctaagcaccgtcgtgaccccttacgagatcaagaaggaatgttatctttgaggagctgtcttgttgatgctaggagaaagttgctctttatggttgagcaggtattcctgccagcgggggaggactggtcaatgcatgaggcagacacacaatgcctgggtgggtagagggaagggtggagaagagttcatatttaaatttctattgtcttgccataaaatatgaattttatctcacaaaccctagtacacagaaatgttttgtcacagtttgcagaagagaaaattcatagaatttaagtactgataacttgcccaaggttacacagtaagtggaagagccagtatctggctcagtgttctgggcccagagtacactgtgacacagagagcatgaatgaacagttggcataagatgtgtatgaaaacccctctgtcgtccctgtgaaatcctcagtaaaatcagtattgctcaccaattcttttgctgtaatggtctctttctggggcccaggaagagagattatgttctatcttgagatggaccaggaatgaacacaagggtatggaagacatgtcaagatcacagcaagactggaacaagggggaagaaaaagtctttctaaagcctcaagcagaggtagactaatctctccacaatatcctctcctcatgcagcaagatcctggcatgtccagtccaagcaaaaccacagcttcgtagagggaagagtctgaacgcatctccacatgtgctctgcaacactcagaaaaggccaagtcatgctgcagtaacaacagtccccaacccacaatgacttacagctgcaaaagtttatttcttgcgtaagttacatgttcatcatgggtagactgtatgtggcttcacgccatcttctttgggatctaggctgaggaagcagcctctttctggaccattgtccagcctgtggaagaagcgaaaagacacacagcaaaccatgctgtggctcctaaagcttgtgcctggacaggacctatgtcccatgacgtttgcttgcgtttgttgtcaagaacaagtcacatcgtcaagcctgatgttggtggttgggaggggaacagcagagtatcatctccttcaggaagggcccgcaaatatttttgaataatagtataatccacgacagtctcagagctttaaacccttgaggacagaccagaaatttcacccttagtaccatgactcaataaagcgtccttgtccttgatcagaatgcatcctgggaggaggagggaagtacttggaagagaagcagaaagccactagcaccaatcagagatgacaagggaaaggggatagtgcagcttcagctggtaagtgacaagggtgagtgcccttggcagggagaaggggaggtcacagagagacccgtccagaaggagggcccagtagaggagagcctggcactgcccaaagctatcgtctggttagaaaatggagcaactatttttccatgacccagttttaatactgtgagtttgcaaggaagctgagggagccaaactttaatctctaaaggagcttaatttctaaaaaaaaaaaagagagacagagagagagaaacacttctctatagataagtacagttccaatcaagtcagaatataaaaagcaagtcagggaggagagcaggtcagggtgactggcttggtctcctgagttcatgccctctggggctcacagtcagagtgtgagaaagcaaagtagcgtaaagggctgacattcagctgagaggccttagggacagtgaccacatttctccacaaaaaccatggcacacacattgacaaatatgtttatatgacctgggccagaatattttattttatttatttattttttgttgttctttttttttttaattaattttattttttaaactttacataattggattagttttgccaaatatcaaaatgatattttaaattaaaattgccatcagaatctggcatataaggtcatggggcccatggagatccctacagctcctaaaaccaagggtccctctctggagtggaaccagctgatttgacctttccattggctctttgagaatctgaatattttttaaaggattctgggccagcttcctaagataagaagccttttcgaggaaagtggtggattgtgttggttaagaggcaaaaacaggtgacatttcaaggaaaaaggaggttcaagtttaactctcatgttttctggacacgcataggtgtgcataatgaaaagccaattattcatggatgctgttagggtatattggttcagctgctttaacagagatgaaagcaggagagacttggagagaaggttcattttcctctccccctgacattcgagccatccagggcagtccaaggtgtgcagcagttctaacaggtcagccaggtcaaccctccttgctgcttcctgtggtctcccctcattgaacttgcttcactatccctaagtccactttccagcccagataaaaggtatggagggcaggcagcttccctgaaggacaggaccctgggggtggtacacctcagttccacagcatcccatttgctggaacttagtcacatgggcatgggcttccctggtggctcagctggtaatgaatccacctgcaatgcaggagatcccggtttgatcccctgggtggagaagatcccctgaagaagagataggctacccactccagtattcttgggcttccctggtggctcagatggtaaagaaaccgcctgcaatgcgggagacctgggttcaatccctgggttgggaagatcccctggaggagagcatggcaacccaatccaaaattcttgcctggagaatccccatggacagaggagcctggcaggttacagtccatggggtcgcaatgagtcagacactgaagcacagcacagtcacgtgggcatagctggctgcagggggagctgggaaatgtagtccagcgggcacttctgcacctcgtaggaggaagggagggtagatcctggggaagcatgctcagtaaacagtatatgatatccatccctgagtcaataaagaaaaatcgcatgttgttttagatcgctgaatgggatactatagctaataactacaattgtgactatttctcaaaatgaaaagaattcattcatagtcttcggccttggggcctctctttggcacctgcaaaggctccatagccagtccctggcgtggcagacccagagggagagggtcttggtgaatcggcccattggccacgtgtcgtctggtcccaaagtccccctttcagggtagccaagccttcagaggtcctgagttgcaccatgacctggggcaaaatgaggagaagatggagcttgagatggagcccctccccaactgcatgccctggaccccaaatggtgctgttgggactgcaggaggattcaacacacctctcatcaaaactgagctttctgttccctctcagggtacacctaagaatattggattgagttgccatgctctcctccaggggatcttcccaatccagggatcgaaccccagtctcccgcattgcaggcggattctttaccatctgagccaccatggaagcccaagaatactggagtgggtagcctatctgttctccaggggatcttccccacccagaggaatgagacatcttcctctcctccatcccttccccatctctctctttctgcaggtataaccccaaactcctcctgatcccctgccccatggataaccaaacaaaagcaccgagtaactggcaagataacccacttaaaggcgagtttgtgtttgagcttcttacatggccccttatcccctttcaagccagggtttgtaattctttgccagagaagcaagctggctgaccactgtccctaaactcttaacatcttgtccagggcttttccagtggtcaatcggagtcccattagagtccccatccccacaggcacttgggtttccagggtaactgcagcaccgtcctccgccgtccaggcagaagcctcacaatgtcagggaagcgggccggctgtcagcgggcccgcggggcgccagtgacagtggggagggacagtctgggatgacagcaggaggcccagggcagagttaagccgctgctaaaaacggcagaggagacaggctttgcacattggaaggacattcagataagcctggcctcctccccttcccgagggccctggagctgtctgggagctgcgtcctgggcagcctgacgttcctcatctgggcatcgcactgggggcttcctgaggacatgggtggatgtacaggtggaggaggggtggggaagggggaggggaaaaagaagcagaggggatgggagagggagggagaaggagcagggggagggaaaggtgggaaaggagaggggagggaggaggaaaggaggaaggaggaaggaggagagaagggaggagggaggggagggtggaggggtggaggggaggagggaagaagggaggaggaagggaggaaggaaggagcaggtaggggaggagggagggaggaaggaggaggaaggggaggaggaagggaggaggaagggaggaggaagggaggaggaatggaggaaggaaggnnnnnnnnnnnnnnnnnnnnnnnnnnnnnnnnnnnnnnnnnnnnnnnnnnggggaggggggaagaggacagggaggggaggagggagggaggaagggaggggaggaagggaggggaagaggaaggggaggggaggagggagggaggaagggaggggaggaagggaggggaggaggaagggaggggaggagggagggaggaaggtcatgctggagaaaccaatctggaaaggctacatactgtatgatttcaactagatgacatttaataaaaggcaaaattgcagagaaaataaaaaagatcagcagttgcctggggtgagaggaacagaagtacagagacaaagcagagatgatttttaggccagggaaaatactctgtgtgatattataatgatagccacttggcattatacatttgcctaaacccgtagaaaggacaatacccagagttaaccttaaagtaaaattacagactttgagtgattatgatgtgtccatgtaggttcatccatggtaaaaatacacatatgccattttgatgactgatgttgataatgcgggaggctatgcatgtgtatgggaaatctctgcacctccttctcaatttcattgtaaatctagaacctctctttaaaaaattaactcttaaaaaatcagaaagtcggtatgatgctgatgagagggaaaagcaggtgttggccgcagtgttgtgaaatgcctctcctggcgggctgtctctacattcttcccccagttattcacaccacaatagccaatgtgtgggaggcccaccactgggcacaaattttttactagacagagaaagtagactgtaacgtggccatttacccacttctgcagaagaaaacaattaggtcataatgacaaagtaaggtccagagaagttaaatagcttgcctgaggggcttccctggtggtccagtggttaggactccacacaccatggcaggaggcccaagttcaattcctggatccctgttcgggaaactaagatctcacaaaccccgaggcatggccaaaaaaataaaaaagcttgcttgaggccacccagccaatggcatgcttgtattccgacccccagtctctctaataccaaggattatattttttccatcagttctcctaactgcattttgcccttgagttgtcaagagtaaaatctatagggggagaatctatctctttagctactctggactatctcacactggattccagtaataacatctcctcaaatacagtggctcaagtgggataaagatttatttctgtcatgaaatagtccagacaaggagtacaggggcgcagctcaactgtgtgtggagccaagacattttcatcctttgctgttccatccgtaagcagcttctccttgaacaaattgtcagggatggctctccatcacctccatattccagcccatgaaaaagggatgaagcaggaagggagtatgggtatctttgagaagttgcacactcaatttctgctcacatcccagtgacccaacctgaccacacagttggtcataattgtagcctacaagggaggctggaaaacatcatctttttaactagattactcaatttgataacaaaggtccttctagtcaaagctatggttttcccagtagtcatgtatggatgtgagaattggactacgaagaagctgagcacggaagaattgatgcttttcaactgtggtgttggagaagactcttgagagtccctgggactgcaaggagatcaaaccagtccatcctaaaggaaatcagtcctgaatattcattggaaggactgatgctgaagctgaaactccaatactttggcaacctgatgtgaagaaccgactcattggaaaagaccctgatgctgggaaagattgaaggcgggagaaggggacgacagaggatgagatggctggatggtatcaccaactcaatggacatgagtttgagtaggctctgggggttggtgatggacggggaggcctggcgtgctacagtccctggggtcgcaaagagttggacacaactgagcaactgaactgaattgaactgaactgactcaagctgaaacttctgttactgtggaagggaataaaggatatcgtggaagacaatggcagttcctatcacaaaattaataggggagatttccttaatcagagcacatacagaagagatgtaagtttgcctgggaagatagaataaccaggattggggattctctgatctgtttccacaacgtgtgctcttggtcttcacagtgactgccctagtttgggttctgaagcctctggactgtttcacttgtttcataataggtctttttagctcctgtttctttctcatataattccctacatcaccaacaatattctaaatggtatcctaaaaatcaaatctaattgtgtcagttccctacttaaaatcttttgatggcttcccaccgcctagaggacaaagtgcaatctgctaagccaagcactggaaccctggtcaacttttaaattttgtattttatttatttatttgtttattttcggctgtgctgagtctttttgctgtgaggctttctctagctgcgatgagaggaggctactcttcactgtggtgcacaggctcctcgttgcagtggcttctcttgttgcggagcacgggctctaggcatgtgggcttcagagttatggcacgtcggttcagtagttatggctgccgggctctagagcacaggttcaatagttgtggtgcacagacttagttgctccatggcatgtgggatcatcccaaccagggatcaaacccgtgtctcctgcatcagcaggtggaccctggtcaacttttaactctcatctttgaccaccctcacatctttaccctaagctgtaggcagatggagacaatcagttcagttcagttcagtcgctcagtcgtgtctgactctttgtgatcccatggactgtaacacaccaggcctccctgtccataacaaactcccagagtttactcaaactcatgtccactgagatggtgatgccatccaaccatctcatcctctgtcatccccttctcctcccgccctcaatctttcccagcatcagggtcttttctaatgagtcagctcttcacatcaggtggccaaagtattggagcttcagcttcaacatccgtccttccagtgaatattcaggactgatttcatttaggatggactggttggatggagacaatagtaattctcaaaatgccacacgctcctgcttgtactgtatgtttcattgaccttgtgtatgatgctccttctgcctggaagcctatccctgctctgtcctttaggtcaactcagtcttcaagggctgaggctcaacatgtagcttcagtgttttcctcttctttgagcccccaggtagggttggtcacccagaaggtggtgagaagttggggggacttggaggcagacaccctggatgcagaacccacgtctgccacttactagccaggtgaagctgaacaatttcttaaacctcatttttctaaactatagggtacagctaatcatacctacctcatgtcattattatgaaaattaaataagatttgcatatatgattcctgacccatcaaaggtgttcaactcatggaactgttattaaaattattactctgagtgagttgggataaagctaagctactgtaacagaaataccctaataaaacatgtggggaaatggaatgatttttctcttgagacgggtttgggttatatgggtgaatacttgtcaaaactcaactgttatacacttaagttttgtgtacttcattgtatataacattttcatcaagaggaaaacaagtattggagtctaggtaataacatgtatgccaatgtaccaaggaacatatacagatgtctgcaatatactttgaattgtgtccaaaaagtgagaaagtctggtgcatggatagttgggtgaaaagatcgataggcttataattttttttttttgtagtaaaatgttaatggtagatacaagctgtgggcatatggctgtccattgtgtaattttttaaactttgctctatgtttgatatttttcataataaaaataaataaaaagacaccatcataaagtagtttttaaattatagttgttcttctccgcctcaagtaacagtgctaagtgagtatgccagatttatgggcagttctgtcccatctgttcactcaggggtgccaggcttgcgggctgggactcaattttttccaagttgtcaagtcactgctccattatcctccagactcaaggacatcatcctcatctgtggccaaagctgaatcactctgtcacattccaagagaaagaaagactagagggggcacacccatctcttaaagccgactccccgctgtggacggcatgacttttgtctacactccattgtgagaactaagtcacatgaccacatgccacagtacaggaggctgggaaatagctaactctattggttaggaagaaggagagtatccccaccctgtgttctctgagacacaccagacagccattcatcacactgtagtcatttggatcctgcaactccttgctgatagaaatagtgttttgcacatcttggagtcatcaaaaccaaatacaagggctgaaatgagaaaggtggtgaagaaatgtttgctaaatgaattagtgcatgaaaataaaactgcataaataaatgagatgagcaatgaatagtgccttctttggagcatacgtttcttagtatgtatctacttttattggtggaaagcaagtcatctcttgatattgtagacctataatatgccaactcactcaaatcaagtaattccttattgatttaggcttctttcccatccctcctcttttctcaaattttatcttcatgaggacaagatgtttataaagtttaccaacctacatgccttggaagaaaaagatttaacctgattaagaatggaaacacttttccacattattaaagcacttgggtaacaccaatttggattaaaataatgtgagatggcatatgaaaattgtctacttatgacaatgagttcataacatttctactggttaccatttttaaaaaatctatgtaagtgcttagaagtaatatagctgtgtttcttccattatattctgtaattctaactttccctaactcgtattgaattctttgcgagttgatccaaattattgtgtttttaactgcacttcgccaacatttaattggagatttaaagaaacatgatactattgtagacggcatttagctcaagtattcattggatcactattgaaaaaaatagaataggaaatctaaccttctctctcagtttttattggtttgccttctacaagctacagaactgtcctttccaattctcatgcatttcctcttttaaaaaaaatatttatttatttggctgcgttgggtcttagttgcggcgtgtgagatcttttgttgtgatgcactgactctctagttgcagctcatgggcttagttgttccatggcatgtgggatcttagttccccaaccagggatcgaaccctcatcccttgcattacacagcagagccctaaccactggaccaccaagaaagtacctcacgtcatttctttctcttcaattcagagagcttctgcttttcaggattcaaatcaaggtctccatgtgtagctctgtggtgaatagtgaatttcccaggttgttttaatgggatctccttatgtctgattattggaacttattttcagcaagctggtttgataggcacatgctagctcagaagctacagtgaatttggatggttcaggaactggctgtcagaagaaagatctcatttgggtaggtatgaacctgagtttgtacctcgtaagagaaggcagtgatatggaaaagggagactttgcaacaggaggttaagtagaaagaagagtggcttaccctggcttggggatgaagcagtgaaggctgcaaagggcaagcagttcagtggtggaaagaggctgctgggaacagcctgggatgactgagaagagacctgtcgacctggacaggagtaagactagaatgcgtctgaggcctgagatgaagatgcggatcgcttctcatggcaactctggccaggtgggttagtgctggggctccacttttagggctgcagaattcaggaccaccaccgcttttgtcactaagttgggggtcttccagaccactctcactctgacacaaattgcaagtttgagccatgactgttactctaaaactaagttcatctcttggagggtgttgagacaagagatacagtcaagacaaaggttgggagaaagaaggatttattacttgcagcaagtaaggagaacaccagggatcttttccaaagcagtgtctccccagacagcgaaattgggggagttttaagccacgggtatatgagtattcatgaaggggtggaaacaatcaatggagcctaagctttggttgattgaagccatgaaggtcagaagaggtcaacatcatcctctcttaggttccaagtgatctggtggtagaaacatcaggctaatctttaccactgaaacagaactgggagtctttgaaagtgaaagtgatagctgctcagtcatgtctgactctttgtgaccccgtggcctgtagcccaccaagctcctctgcccatggaattctccaggcaagaatactagagtgggtaaccgttcccttctccaagggatcttcctgatcccagagtagaacctgggtctcccacattgcaggcaaattctttaccatctgagccaccagagaagcctggttgggggtctttacaactgattcattgtctttgctattgttactcctcttgcctgataacagttacttgttcctgcatccttttgttcccttcagattattattgagacctgttcaaggacaaacattgtggccaggcttagatcaaaaaatggcctaggtcaaaaattacttctctcatttcaagaaagtcctgcctagttctcttcctccaaggacccttaccctgtctacttacaagaccaccttcagaattaacacaacatcataaatctatacttcaataaaataagttgaaaaaaaagactacattttgggtgcaataatttgctagaaggactcacagaactcagagaagtcattatacttgtggctacatttcattgatgtgaaaagattccagtgaaaatcagccaggggaagagagtacaggatagggtcctggactcattagatgcaagttgtcccgagaacaactgcttctccatgatataatgtgatgtgaagcaatatgcaggaagtattattaaacagggaagctcaagcctttgtgtccagagtttttattcgagttcagtcatgtaggcacaggtggacatctgcatggctgacttttgtccccatcttctccaaaaggcaggttttgataccatgtggtccaaggttccccaccataaatcactttgttagcatagactttctgtcaaggcccaaggcctctcaataagcaaaggcacttttattcaggcagggcattgacaaggtaaattctatactacacacagagtcattcattcttgattagtggccctatgcccagagcatatcagtgcatcaaatctgtggcagaacatcagacagaatctcaacagctcttctgcctaaaggcaaccttggagttatcacgggaagtaaagccccaaaatctgaacaaggaatatgagtacacatgaagaaagaaatcacacccagggctgagagatcaggagcttgttcttactgggtgcttatcctatgatgcttaggtaggtctctcattaaaaaaaaccaagactggagtggttcacttgaaaagcttaaaaaaagtccaactaaatagatatttggaatcacattggttgtgatgactaacatggacacctggaattttccatctctgcatattatacccagaataactgacactccaattgtgctgacggacaggaacaaggcctggatgtgggagtagatggtaggtttcatatggcattcaaagaaggcaagtttcccttcttcttgggtgggaaacaggaggaactccagatgaatctgagctttctcaagaagattcttcagaagctcatgaagagcaggatctgttcccatgcctgtcctgccaggagaagagaccatccaaagccaggctcttctgccatttcttagactaggccacgtaggattggaatggtattactgagcatggagcatctctaaaaatccaatgggggatccttatagaaagactttggcagagcccgtagccaacacattaatttaatcaacttgtgcttaatatttatagccctcttcctatgtacttgtcagcggattcagttccaggaatatcaccataaagctcactccaaaggagcttatgttccaccctaagtcaaacatatttactgaattcccactgagtgtaaggtgtacattctcttatttgtctagggtctatgtaggttaggcttctctgatggctcaggcaataaagaatctgcctgcaatgcagaagacccaggttcaatctctgcatcaggaagatcccctggagaagggaatggctgcccactacagtatttttgcctgggaaagtccatggacagaggaaccggctgggctacagtccatggtgtcacaaagaatcaaatatgactgacagactaacattctgcctttcagtacgtagattatgtgatggtggcatctgactgctccatggaagatagtggttaagatctagctgtctctctacctcctcttcctgaatcccatgggtttctgagctttggagaagatctagaatccctggtgaccaagagaaggaaaatgctgatatgagtgattagtggaagggctgagaaaatcagctggatatctggcagtaagataatggctggagtatgttatgattggtcaggttcatcccaacaagttgctaattccgaatatcacactggctgggtcgtctccttccagggatcattcccatcaagggctttctcttcttaagaggaatcctggtctcgatggacaaagactgccttaaagcagtagtccccagcattcctggcaccagagactggtttcatagaagacaattttcctacagatagtgaggagagaggggggatggcaggttggtttggggatgattcaaggggattacatttattatgcactttatttctattataattacatgatctccacctcagaccatcaggcattagatctcagaggttgaggacactttctggaaccttccatgtttccccatgaatggtgatttctcccatcccccaccctcaatttcataaaccctaaagattcatctttggacaatgaataaatcttcagaatcattccactggttcattctacctcaggactccacgtggtatttgattccgatagggcttctttgtgtgcaagaaactcttctgaaatctcccaacaagaaaccaagtcatattacaccgcattgtatgggaaatccacaccattctccccctccctagtgagggtaatcactgccaattcattgtgcttttgtgaaaatgagttatttggaggggttccaaaagaggccaggaaaggaggtaggagattgtgtgttaatcgctcagtcacgcctgactctgcgaccccatggattggggcccaccaggccccatggggttttccaggcaagaatactggagtgggttgccattcccttctccaagggatcttcccaatccagggatcgaacccaggtctcctgcagtgcaggcagattctttatcatctgagccactcggggagtcatggtagaagactggatggatggatttggtgacgtaaaatcatatagatttaaatgcagtacacttcatagagttgttcttttgatccttgctgagaatgttgattaaagagagaagttatccagatttgtgacatttggtaatatgattatattatcttttacaattttatgtatttatatttaattttttacatagtatgcaggatcttagttccccaaccaggcaccaaacctgtaccccctacagtcactggaccaccagggaagtcccccaccaaaacttttatatttgactagatagtatatgcctacatttcaaaactcaaaatgacatgcaaatattcatattaagaagttgtgtcccccacgtatccttccctcagaggtaaccacttttgcatcattttgtgtttctttatgcaaatacaagcaatgaagcttcctctctggttttggggatcccacactagaagagcttgccctttccctgtaacctcagataaacatatatgtccccagccttctccacagttggggccaagttgtataatctaggctcagccaatcaaaaccacctgcccaaagtgtgaatcggaaggaggtgaaatgccaaagcaggcacaccagagacactgatgcctttgaaccactgcagtggttcaaactgcagcatttgaagtccagggccaagcaggtcagtggtatccactgaggcatttgcaaagccaggttaacagtgagtccaatgactctttgcttgcttgctttcttctttttttgtgtgtcacagcatgtgggagaagggagcaacagaggatgagagggttggatggcatcgctgacccaaaggccatgagtttgagcaaaccccaggggacagagaaagacaaggaggcctggaatgctgcagttcatggggttgcaaagagtcagatgtgacttagcaagtgaataacagcacatgtgggatctcagttccccgaccagggattgaacttgcagctcctgtattgggagcacagagtcctaaccgctggagccagggaaatccctccaatgactctttaccttcaggcctcctcactcgactgagcctcttccaaaacctagaagaggatttcagcaacatgttgatgcatttttgtagaaccttcaaagccaggtattctcactgccattggttaagactccctttcccgtcacaagaacactctgtcctttgtactcttggtattggagtggctgcagcattgagagagggacaagctaattatggggaaggtaagcggcggtacatttaatctgggtctagtgcaacacttctatgtggttctatgtgctatccaacttggtatcagaatggcttccaggaacactttaatctcccactgtgctgattcactcagcctcaggtcataaaggttcaggaccaggacttgtcctgcaaatagatatgtccttcatgccaggttctgaactatgtggagagcagaggagaaatcagatacggaatgcacagagccagaagctcgtctgtgggaaatccttctggacctctcaggatcacaaatgaaacttgatagaaggtttcccaaatctgacaacaatccaacaactttccatgatgttgacaataacgagtatgaagccaaaagaaaattttctaaattataaaaaatacaaaacaagtttggatttcagccagctggtgatcagggttaacatctgatgagatgaaagtggtccttcatctgtgtggtcttcttgccccaaacctagactctatgtcaaaccatgacgaaaacagacaaactcaaatcgagggacattctacaaaatatctataaagctcaaaactttcaaggttaccacaaagaagggacatctgagaaactgtcatagcccagaggagtataagaagacatgactaaatgagtgggatgtgttatcctggaatagaaaagagagcttgaagtgaagtcactcagtcctgtccgactctttgtgactccatggacttgtagcctactacgctcctctgtccatgggattttccaggcaagagtactggagtgggttgccatttccttctccagaggatcttcctgacccagggatcgaacccaggtttcccacactgtaggcagatgctttaccctctgagccaccagggaagtccaaaaagaaaagaaagcttagggaagaactaagaaaattcaaataaagtgtagagttatttaataacatttcaaatttgattcatttgttaacagatacataataagggaaaatgggtgaggtgtataaaggagctctttgctctatctttacgatttctgtaaatctgaaactcttctacattttaagttacctggaaaagaaatctgggtcaaccagagtaaaagaaagactgaattatctcttccctctatcagttcagttcagttgttcagttgtgtcaaactctttgcaactccatggactgcagcacaccaggcttccctgtccatcaccaactcccggagcctgctcaaactcatgtccatcaagtcagtgatgccatcaaaccatcccatcctctgtcatccccttctcctcctgcctttaatctttctacagaaaatactataaattacattttataaccttattcttacatagcccaaaaatgaaatggaaaaatataacatgagatgtgtcaggcaaataaattattatgtactatttctagattttatgatgtttatggtatttatcagctcttaaaaatgttttttgatatttttttctctcattctaaatatttgcttttgtgcctaattttcagttcattattttttgctagagaatgactccttgaaaccaagctctgcccccttggtctatgtgtgcagctgtgggcaatagttttatcatgattgttgctgttttttagttgctaagttgtgtcccactctttgtgaccgcatagactgaggcacaccaggcttccctgtcctccactatctcccggaccttgctcaaattcatgttcattgcatcagtgataccatccaaccatctcattctctcttgccccttttttcttttgccttcaattttccccagccaggatcttttccaatgggtcagctcttagcatcaggtggccaaagtgttggagtttcagcttcagcatcattccttccaatgtatattcaggaccgatttcctttaggatggactccttgcagtccaagggactctcaagagtcttctccagaaccacagttcaaaagcatcaattcttcagtgctcagccatcatggtaccaatctataatatgatgtaggacatttgtattgttatttggccctcccaaagatcaaagataattatttaaatattatttaaataaacccccttttttgcataaatcattcatagtgtgtttctgctgcttataaatgagaatttgatgaaaaagttggccataatttaaattagtggttctaagccctggaggtacattagagtctcctggggtgggggtgggggaagggggttagaatatgctaatactcaatcccgtgtgttgaaccagcatttccaaggctaggacctaggcatcagtggtttttaaaagtccttagataactctaaggttcagccagccttgaggaccgttgggtacagtctagtctccaagtggttccaaatcaattatttatattaggggtcctaattttatgcctatcactgtgctgggtgagatgcacagaaggtgaaacaggctgtcagaagcccacttggtctgcacatcccagagtgagaatgaggcgtttgtattttcctttgagaaacagagggagagaaaactgaatgcaccctgcctggggagaggaggaaatctgtccggaagacctgtgttttggtttatcacatctaagggtggtaagagattctgaaagaacgcactatgaattcccagatgcttccgacaaatttaagtgcatgtagaaccttccaccagaactctcaactttgacattaatggagggaaagatgatctcaaatggcctgcaggctctgagctcctgccttcatggagatggaatacaaaccaactagcaacttggtgtagttgctgagaaaatgcaaaggaagagagaggttgctcacagtaacaacaaaaatataaaatactaagaaagcaaggggcatacagaatctagagtcagaaaactataaactttaagttttttaaagcctacttaaaaaaataaaatagaattggggtagtttaacatcataaatgtattcatccatcccaaactaactatacacattcaatagaatttcaatctccatcccaaaaaaattatttttggaacttgacagtcattaataaatttctattgttttaaaataaataaataaagttgaaccaacagaatatgtgaaactggtcagtttttgtttttttttttttaaagaagctgcggtattgatttttaccagatattaaaacatattttttaagtgacaaaaatataaacagaatgatatggtcttaggaacaaacagataaggaacagaatgaaaagtaaagaaataactctgcttattataaataatcagatataataaagatggaattccaattaagtggagaagaatgaaccagtccatacatcattttggaataactggctaaccatttggaaaaaatcaagcaggatttcctcctcataacaaccatggtaataacttgcacatggtttatatattttaaaaaaaatcaaggtaccagaaggaaaaagaggtaaacttttgtgtaaacttgtaggaaggaaatgtgtagtaggaaaagctttctaagcacaccatcaaaggaaatatcagtaaagtagcatattcggagaaatgactataataaatattttagtctttagagttctaaaaaaagaaaaaacataaatgataaattacatttgggaaaatagctgtgatctgtgacatacataggatttaatatcttaaaatacaaagggatacctgatgaaagaaagaggcaaatagtgtagtataaagtaaatgagatagaataagaactctctattcctacaatgagtgcacacaatcaacataaaaaaaaaaaaggattcaacctccttagtcaatagaaagtatatgaaaacaaagcaaagctacttttggtctaaaagattagcaaagagggtgtggaacaataggttcacctctaaaaatataaacctataacatcatttctggaaaacaattaggtattgagtcttcacagtcttgcaaagattcatttcctttggcccaggaatctctttttgagaatgtcattctaagaagtgtcggcataaaagcactaaaaggtaaaattaagcccatgtttaggcatcagtgaagcaaagaaagcttttcttttaaaatgaaagagttacactattaaaaaaataattgttcactaacttagaatttaacccacaaatgatgtaaaacattgaaaccctaacccacatgagcaacatatatttgggatcttgtcattgtcatttctatatggccaacatatgcttattgaatgaatgaaatctccaggggtcattcagcctttcccatcacagagtatcttatattcatttctcaagtgagtcctgttcatctgtaataggttaaatatactcacccttttcgattaaattcaccctttgaattaaaacattgacatgaaaaaaaaaaattgtaatatactgagtgactgaactgaattgaactgacagtggaattatatataactttgttttgtatttcctgtctcctataaatatgctatcatattttcataacttaaaaattaaagaagaaagagaaaaaaaaaaagagttgtagggataggagagagggaagggtgttgttcagtcactcagtcgtgtccaactctttccaacctcatggacagcagcacaccagacttccctgtccttcaccatctcccagagtttgctcaaactcacgtccattgggttgatgataccattcaaccatctcatcctctttcatccccttccttctgcctcaatctttcccagcatcagggtcttttccagtgagtcgtccctttgcatctggtggggaggaagggcaatatagagataggggacaaagagatataaactactagatataaaacaagctatcaggacatactgaacaacatgaaggatacaaccaatatgttgtaactacaaaaggagtataacctttaaaaatcgtgaatcactacattgtacacccttaacatataatattgtacatcaactatacttcaataaaaataaaaaaagaaatacatttgatattcaaaaatagactggaggagtatcatagtagataaaccagaatcgggctgaacttttttttatgacagtctatggtgtcgcaaagagtcggacatgactgagcagctaagcacatttttattttctaatttgaggtaggcaagggaatatggtgggcaaaaccatgattcactgtttcatttatctttagatctccttccacactctgcataaagatatttaacctactaccatgtatagtaatgaaaaactagaaaaaatagtagataaaataataaaagctttgtttcaagtgtatgcacaatcttattacagactcctaagagtcttataagtcttatgctaggagccactaaaaattataattgcaaatttatatttatagacatggaaagatattctcaatttacaaggtaaaaagtaaagttcaaaaacaatcatctggtaagatcttgtcttcgttaagtaaatatttaaaagtatattaatgcacagaaatagaagggaaaaaaaaaaaagcccacaagaatgaacacaaaaatggatacaatgagtgtggaggtgaggagaggggatggttggtattttttaaatctgtattttctaaaattaaaaattaataacttctggaatacaaaaattatgttaatggagatttttagctgctccattataataccttctggaagaaggcagggtataaattaattatttaatcaaagaaatatagagcagggacttccctggtgatccactctccctatgcaagggccccagttcaatccctggtcagggaattagatcccacacgcctgcattcagcaatgaagatcccacatgcagcaactaaaacccagagcagccaaattaaaaataaaattaaaaaaggagtattaagaaagaaagaaatatggagcagttggtccacatgcctggtcccatctccaaattactaggcacccttgacaatgctgtgtatttgcaagaatgccgtgggttctaaaacatttgaccttcaggccatctgtcctcttcattttctcagcctgagggtgcctgggggtgctcagcctttgttaaagatgagggggctgaaccccagagagctcacctgtccaagcgtcatgaagaaggacagcatccttgctgggactaggcaggtccctagggctactgctttctgccccacagatgacattctcgagttcttttgccatccttgctatgcatccagtccagacacctccttcttcaatagactcggggcttttcctttcttcctttactggggtaggaggggatgggaatgggggtcccttagatcagcatttgcaggccaccatgaaaaggccacagctcatgggagagagagaaagtgagcaaattacagtgccatctcaaaggagacggtggagacttaagtacagcccaaaaggatgaccatcgcccccagggagcaatagggtttcaaagagggttgacacctgggggatgatgcctttggtccatggagcctgaagctcccctcgagccttgccagcctctctgggaggcctcacaaaaactgtccacctgcctctctcctgggaccacagcaagggcccgtgggagcaggggacactcccagaggctgctcccggcccttctgtcagccccatctttgcccccccccttttttttcatgttcttaccactggttcacatccaagcacgtgttgccttccagatggaggcacgcttagcgtaggtctcctggagccccggagaccatgctcgggagggaggccacctaaacttctgtctgtgacgtatttgtttctggtgaagtgaagtgacatgaagtcactcagtcatgtctgattctttgccatcccatggactacagtccgtggagttctccaggccagaatactggagtgggtagccgttcccttctccaggggatcttcccaacccagggatcgaacccacgtctccggcattgcaggcgtactctcccagctgagccaccagggaagcccttgttgctggtgcagaaggagtaagacccagggacccctacagtctgtgttgtgctcagtgtctcagcttctgtctctctctctagagtggggacactaattctccatgcagatctattagagaactgagttaattcagagaaaagacctaatatcagttaccacttgggccacagcctcctcttgggaaaaatgcaaagcttggtggggtatccttgtgatcccagccagctccactccctgggagccactctcttcccctcccagagctaagagctctcaaacatggatggctcttcacacggccatcagatcagatcagtcgctcggtcgtgtctgactctttgcgaccccatgaatcgcagcatgccaggcctccctgtccatcaccaactcccggagttcactcagactcacgtccatcgagtcagtgatgccatccagccatctcatcctctgtcggccccttctcctcctgctcccaatccctcccagcatcagagtcttttccaatgagtcaactcttcgcttgaggtggccaaagtacgggagtttcagctttagcatcattccttccaaagaaatcccagggctgatctccttcagaatggactggttggatctccttgcagtccaagggactctcaagagacttctccaacaccacagttcaaaagcatcaattctttggcgctcagccttcttcacagtccaactctcacattcatacatgaccactggaaaaaccatagccttgactagacgaaagtttgttggcaaagtaatgtctctgcttttgaatatgctatctaggttggtcataactttccttccaaggagcaagcgtcttttaatttcatggctgcagtcaccatctgtagtgattttggagcccagaaaaataaagtctgacactgtttccactgtttccccatctatttcccaggaagtgatgggactggatgccatgatcttcattttctgaatgttgagctttaagccaactttttcactctccactttcactttcatcaagaggcttttgagttcctcttcactttctgccataagggtggtgtcatctgcatatctgaggttattgatatttctcccagcaatcttgattccagtttgtgttttttccagtccagcgtttctcatgatgtactctgcgtataagttaaatctttttcattataggggactggaatgcaaaagtaggaagtcaagaaacacctggaataacaggcaaatttggccttggaatacggaatgaagcagggcaaagactaatagagttttgccaagaaaatgtgccggtcataacaaacaccctcttccaacaacacatggccatagattttcctaaaaaattttgttaatctccattagctagacactccaattagactatctcttgttttgctaggaaaatatggtttttagccttctattctggcataccattatatagtgttcttttatcgtttcttttaaaaaaatctatttgcagggcaggaatagagacacagacacggagaacagacttgcgggcacggaaagggaaggagagggtgggatgaattgagatgttgcccagttgcccagtcgtatctgactcttcgcaaccccatggactgcagcaggccagtcctccctgtccctcaccatctcctggagtttgcctcagttcatgttcattgcatccatggtgctgtccagccatctcatcctctgacaccgtcttctccttctgccctcaatctttcccaccatcagggacttttccaatgagttgtctgttcccatcagatggccaaaatactggagcttcagcttcagcatcagtccttccagtgaatattcagggttgatctcccttaagattgactggcttgatctccatgcagtccagggaactttcaggagtcttctccagcaccacagttcgaaggcatcaattctttggcatcctgccttctttatggtccagctctcacaaccgtgtgtgaccactgggaagaccatagtcctgactatacagcctttgtcatcagactaatgtctctgattttcaacacactgtctaggtttgtcctcactttcctgccaagcaatcgttttctgatttcatggctgcagtcaccatccgcagtgattttggagcccaagaagaggaaatctgtcacttcttccacctgttcaccctctatttgccatgcagtaatggggccggataccatgatcttagtttttttatatttagtcttaaaccatatttttcacgcttctccttcaccctcatcaggaggttctttagctcctctttgctttctgccattgaatggtatcatcctcctatctgaggttgttgatgtttttccgcctatcttgattccagcttgtagctcctccagcctggcatttctcatgatgtgctcagcatgtaggttaaacaaacagggtgacagaagagagccctgttggactcctttctcgatcttgaaccaatcagctgttccatacagggttctgttgcttcttgatccacatacaggtttctcaggagacaggtaagatggtctgccactcccgtctctctaagaacttcctatagtttaccatgatccacacaatcaaaggctttagtgtagtcgatgaaacagatagatgtttttctgaaattcccttgctttctctacaatccagcaaatgttggcaatttgtttctcttctttttctaaacccagcttggacatctggaagttcttgattcccataatgctgaagactagcatgcaagattttaagcaagacttttctagcttgggacatgagtgcaattgtctgatggttagcatattttttggtactacccttgttgagatatgggaggaggattgagattttccagtcctgtggccactgctgggtcttcagaatttgctgacataatgaatgcaaaaccctgatggcatcatcctttagggttttgctggaatttcatcacatacactagctttattaacagcagtacttcttaaggcacacttgacttcgcactccagaatgtctggctctgggtgactaaccatcccatcatagtaatccggtttgttatgatctgcatattaagattcagttcactaagatctttactcattacaatatgtaacatagacagctagtgggaagatgctgtgtgacacagagagctcaacccagtgttctgtgacaacctagagggctgaggtggggtggaagggaggttcaaggaggggacatacgcatacttatggcagaaaccaacacattataaagccattatcctccacttaaaaaaaaaaaatctttccaactgcttgtctttcatggaaggatagaaagtacatcatttctggagggactgtgtaaatgatttaatatcttagataaaatcaaatttatgtcagatagatgcaaagctaatattgatttttttaaattttattttggcccgactctgcccagctgcagccatctcaagtgagaaactggtctttcagctcaagtgttccatggtgatgtgttcacggctgcccaagcgagaagcatctgtcaggaggcagtttgtcagtagagatgggtaaggagaagatggagcaaggctttggtccagggctttctgagcttggagcatgtggagacagagcaggatggagccccgcagaagccggtgagctgtttggagggctcatcctgggagctcaggctgggagaactgaacaggagggacttgcatgcctgcctcccttccttccctctgtgagtcaagacctttgactgccccttccacctttttcatcgggggtacagggggctggggagccaacccagcaaaacttagtgacttaggataacaaccaacagtcacacctttgctcacagttctgcagactgggttggacctagctgggaacctctgctgtcgtgcctagggtcactcatgcagttatcaccagatatctggggacaccaccagggctccctgatggattggcttctacctcacctccagttaataatggctggctggtgaagatctctccatgtcaaatgggtgtgcatgctaagtcactgcagttgtgtccaactctgggctaccctgtggaccgcttgctcaaatgtacagaacaaaacacacctaccagaacatgaatgaccaagaaaacacagcacggttaaggtaagaaaacagacctccagcaatcaacatggtaaagtggaaatctgtgaaccgccttcaaagcattaaaaacaaccatggtccaacgaagcgtggagcaagactatcacctcccaaggcttggaatccaaggagatgataatacactggacagcatttcctcattttcagatcatatcacaagggtttcctcaattcggacccagctttcatcaactccactttaaggaggaaagaggaacacacgcggagctgatggctgggcccaggtcagggtgcctagtgtcctggagagaactccaagttgggcctccagcttcctgtctatgcctatccctgcactggctgcactgagcatcatccttaagaaacccttgggcaggtgctcttgtgcccacgcccaacactagggagcccagagtgggtgagtaacctccctgtggtcacccagctagatggcaggagcctgtgggtccgccctcctgggctctgccgcagctcacctgactcctgcgagagtccaccacaggcctgtccaccctcgcatgccttgttttactgcctgctcgtgcagccattctccaggcaagaatactggaatggcttgccatgacttcctccaaggaccttccttagccagtgatggaacctgcatctcttgtttcctgcattggcaggtgggttctttaccactagtgccaccggggaagccctactgacttgcttacaacatctcattttattgaggccaggtgaccagtccaaaatcatctgtcaagttcttggagtggatcacaaagacagggtccctttggaatcttccagtgccagcccagggcacttctcccacacagggggcctggtggcacactcagtttggtctgtgttacagtgacaatagctgaaagctcatcagtcctcctatgcttattgccgtgatctgaagctgagacgagggatggagcttcagacaagggatgttgaagacatccttgagcgtgtctttgagctgaagacaagggatggaactactgggaaagatttgaggtccactgaagaacggtccaaggagggggaaggtaggagtcagttcctctttctagatgtattcaaattcagaagggacagtcaccgccctgggtgtgagaggtgatccatcagcagaaggtagatcaccttgacctccgagctcctttctacacagagaggaaacaagggttgtctcccatgagctttgaaactcagctgtaagtggacccaatactgccccttccttatggaaaagccagctgttttgggttaaattgtttctgtctccccaaattcacatgcagaagccctaacccccaggaccccagaatgtgaccgatgtgcagacctagggttgttgcagatggaattagctacaatgaggtcagactggactaggaaggcccctcatccagtgttggactaggaacgcccctcatccagtgtgactatctttgtaaaatggggaagttaggatgtggagaagttaggacacggggagaaggccacgtgaagatgaaggcagaggtgcatctccaagccaaggacacttaagagagcccagaaagccccagaagctaaaggaggggcctggagcagcttctccctccccgctgtcaggaggcacgaccctaccaacccttggacctcctcgtctcagcctccagactcgtgggacgatgcatgggtgtggtggtcctccattaggacggccggagctgactccaactccaacgcagggctgcttttccaggcccctggggacaggcgcctttatcacctttaacagcagcccactttgctgccctgttactccaatgcattcaagggcctggctgccaaagttttgacggccagaaacaaagccattctcaaaatgatcagtggtggggcagctgccttctcagggccctctgtgcgaatgtagccctcctaggcctgggagtctctggctctccttatgttttgcatgatcaccaggcctgcggtgggcagccgcctcccggtcagaggtcagaggccctctgctcagatgaaagcacccacagagccacagggacagagggaaggagtagacaaagaggcggctgggtggccagaagccctgttcctgtctcctaaggactggcctttacagctgggctccctttatccaggcgagggtttcattcaatccatcaggtctctgacttcgacccagattcacaccagcagtgtggcagctgaatgcacctttagaagccaggacccacagatctcggcatcctggggctgagccccacctggggaaggcccaggattggaaggccaggaatcacagccaccatcatctcccagagcctctgtagtgacaactcatgtccctccagtgctcactgcatgaggcatttcatgtgtgttgcattttccatctaatccctgctggaagtgttggggcatggtggtggaccattaccccatcattagtacacgttagggcttccccagtggctcagtggtaaagaatccaccagcaaagtggaaaatgcaggagatgcaggtttgatctctgggtcaggaaaggtcccctggaggagggcatggcaatattcttgcctggagaatcccatggacagaggagactggagggttccagtccatagggttgcaaagagttggactcgacagaagcaacatgcaggcgtactgcatttcaaagacagaaggaaagtgagacccagagggattaaggaacttgcccgaggctgcagaactctagtgcctggagccaagttctgagcttgtaaccactgtgctaaacagcctcgtcttggctgcgtccaaccccctgggagtgtcctcagcagagggtgggcagaccaggaggactggcagagtcccccgagtcatgaaggtcaaggtcgagggcctggtttccagacatttgtctctctggagcctgctgatcttggcactggtacagtccccattttttttttttttttttgcaaagaggctgaggtctagtgaggtgaagtgactggcccccaaatcccagagcaaatcagtggcagaaccaggccaggagtggatgtcctggtttccaacccagcaatctttgttaaataccatgttccatcttagcaagagggagtaattttctcccaccacctgagagattcataaaggatgccgtaaaattgtttctgatccctaaggccgtgatgtacttggtcaggtctgccgtggcaaatattccatgggggagtttgagaaatggggcagatacagctgttttcaattgagacaagcacccaacctgtgcccggcagaatcccctgaggaggagaaacgcaggccggatctcccagaaccatattttaggagtgagctaaccttttggtgaaagtccgtcacacctcctatgcttattgtactgatcactggttcatgtcagcggaagacaagggaatcattttagcaccatattcaaagaaaattcagagagagacagcaagcgttggtagttcttgaggcaagtctgcgaactttttccatccattcttctattcacctctctgttcatctctccacccacccatatatccattcatctttccatccatccatctgtctgtccatctatccatccatcagcccatctatccatccatccatccaaccattgacccattcatccctccaaccattgacccattcatccctccatttatccactcttccttactctgtgaaaagcattcttctcaaccttaggatttacaaaagaacaagtcttagttcatgctcttagaggacctgggatgctattttagagatgaagtcatataataaacctgtaactacaactccatgtattccatgagggaaagggttgaaaacctgaggagcctggagagagcttcttggagggagtgacatttagctgagtagctaaagctaaaaaggctgcctctgagtagctctcagataagcagacaggctccccccaggagaggctgtaagttgtgtgacaggcaaagcaagccccaggcccaggaaagatgccacttcttccaagcagtcagaagttacttgttccccagggcccacttccctttccctcccctctccagatggattttataaacaagataaaatcagaacttaaaaagctaaacagactccacgtggcctctttcactggctagatcagcccaggactgtttttccagacgttttcccagcctgtttgtaggagaggccagaggtaaggagtgtcaagagggagcaagtgctggaagggaaagggggcctcggtaccgtccgggggccggcccgagagatctccatcacctgaacaaacacggagcctcctaccttcatgttttatgaccaccccatccccactctcctccccactctgccccagaaacccagcctgcacccccatcactctcttcccaggagagactttaattcagctccagggcaacgttaggtcagccctattcatcactcgcaaacgcaggccagcagcatctgctgagaacacgcaccctgaggtttggcagcggcaggccaacccctctgctggaggaggggcaaagctaccccgcacgcagccggggcgctgatcacgggaaggaaagtcccaggctggtggtggtcatcgggccagcacctggcacgagtcctgggttcctttccgtcttgctcagtgaggtttgcagcataaagtaaggctacaggtcaatatcaaactgtgaacctcccccgggatcttaagaccaaagcatttatattttactgctctaaactttggatcgtagcgggaaggccagaaaggccactggattggcaagttaagcaagtgcactctgttgtacctcaagtgtgggggaagagaaatcaggtgacatgtggctataagaatagttgtaaagaagaagaaggaagaggaggaggaggggaagaagaagactcagtaagagaccaagttgggatctgaacccaaggcagtctggtctgagtccataagcttaatggctctgccgtggaagccacagagcccggcctttgctttccccgattttaagtacttggatgtcaacaggcacagtcaggccactaaacctgtccagagacccagagggttgaaagctacatcccctgctccgagctttggaactggagggactgatgaggatgtcctgggagtgaaggccagactccagtctggtctggggcttggaggccatcctgtaagctctgcttctcaaagggtcacctgttgtagaatcaacctgagggattgttcaaaggcaggagtctgagcccagacccatagatttagaactttgagaggtgggatgctgagagtctgcgttttaaacaaaccctcccgacccctcacctgccgcactggcctcagggagaccactgcacgagaaagctggaggagcacccaggggactgcctgcctcccggctccccattctgagctcacatctctcctcccaggggctaggagctctgagcatggggtatgcataagcatgtggcatttgatagcataccgatctttcattttttagggagcaattgtcacccatatgggtcactggcttctttgggctgtgtatcattcagggttctccaaaagaaataaagtcaatgggagatacatgcagatggatggatggattgacaggtaaatagatggatggatagatcaatcgattgacaggtagataaatccagatctatctttggattgatcagtggatctatccattcaccaatctatccatctaaggtatttatttttaaaaagctcagatggtaaagcgtctgcctataatgcgggagaactgggtttgacccctgggttgggaagatcccctggagaaggaaatggcaacccactccagtactcctgcctggagaatcccatgaatggaggagactggtgggctatagtctgtagggtcacaaagaatcagacatgactgagcgacttcactttcatgcagttccgagggctgtcaggcccacagttgataggtctggctgggaggctggatattttggcaggagttgatcctacagtcttgaggcagaatttcttcttctccaggaaggcttcttctcagttttttactcctaaagcctctctgttcactggatggggctcacccatcttaccaagggtaatctacttaaagtcagcttctgtagatgttaaccacttctacaaataccttcccagaaacagattagtatttgattagtaaccggacacccagtgggaattcgctatatgacatagggagctcagacctggtgctctgtgacaactagaggggtgggatggggtgggaggttggaaggagtttcatgatggagggaacaaaggtaaacctatggctgtttcatgttgatgtatggtataaattaacacaatattgtaaacaaattatcctccaattaaaaaaaaaaacttttaaaaatgatgacatgaaaaaaaaaaaaaaaagctgggcaccagagcctggcaaagttgacatataaaactgaccatcatcaggtatttcttaattgagcatttgctgaataacacacagtaacataactctacagtttatggtgaaagcggacttcaaagaggaagcaaatacccacatctgctgccaggaagaatctttttaaacttacccaaggcaaagggtcacttcagggctaagcatcctaggttcagcgagcaatgacctttcataatccctgtctcatcctgtctcctggcagccctgagctctagtctcattaaagtactttaattaagatgaattttataagcacgaaggaaaagtaaaattgggccttaattactttgcctccaaccaaataattttcctaggtattctttctttctgaccaagaattttaaaagagacacaaagatgggagtggaggggcacggctaagggaggattaacgtgttgagattggggttctcaacctggggtttgtaggtttcctgaggatccctgcttattacatataaaaggtgcatgcatgtttgtgtgtaagtgcctttttaatgaggagagaatccatactttcatcagagcctcaaaatggtaaatgactcccacatgggttcagaagcttcttacagagtttagaaagataactccatcccacttagaggacagtgaggtggctgattaactgagaactgtgatttttttttttaaataaactttatgtcttagagcaactttatgttcattgcaaaattgaatgggaggtacggagatttcctatatactccccactcccctaaatacacagcttccttcattatccacacaccccaatattgtggtacttttgttatcatcaatgaacttacattgacaaatgactatcactcaaagtccatagtttacattagggtgaatgctttgtgtttggaccaatgtagggccggtgtccatcagtatattgtatccatcatacagagtactttcactgctctaagatcctgtgttctgcccattcacccctccttcccttctgtccacccataagcactgatatttttaccatctccacagtttggcctctttcagaaagtcatacggttggaatcttacagtatgcataatttccagattggtttctgtcacttagtaatatgcatttaagtttccttcatgtcttttcatggcttgatggctcgtttctctttagtgctgaataatattccactgtctacaagcaatacagtttatgcactcacccactgagggcatctggttgcttctaccttttggcaattatgaataaagctgctataaacatcttcatggaagtttttgtgtagatgtaacttttcagctctttttggtgaaagaagcatgtttgtggggttaatatgaattttatagatgaaagaggttttctttaagctcatgacttgaactccaattatcccagtacattgaaaagccatttctgagagtagaacgacttctctacctgagacagcaggttctcaaatgggctggacagcggtttctggaactgtgcaatctggattcagagaccagccacttatgagctttgtggtcagagcaagttacccaccttctctgtgccagtttactcgtgtgtgaaaggggaacaataatcacagcatctgcctcatagggttgtcaggtctgagtgaattaacacatgtaaagtgcagagggtcattcttggcaccaagtaagggttagatttgatcaagcttccgagtatgtggggtgagccctggaatcggcctttttaaccagctcccctggagattctgtttgcagatacagttaacctcacctaactcaactgaacgtgcctattcacagagcaggccctgttttgcaaatcagtacttgtgttgcccaggaatacctggggagcctctgagccctgatggtggtgtcagctggtggtcctggttcagatgggccctctccactggagggatgtgagaggtgactcacagcacagaggctgcttctggacgccgcagtgaggcaggatgttatccacatgtttcctggcaacagggagggaaccaagatggcaggcagggcatcccgaggaagacctggagtgtagccagtggttctctccagcccatgaccacacgagaaccatccacatgggggcacccacctctcacgtgtgtaagggcaccttccccaggtgccttctcccaccctcagctcctctctcaggccgtgcttctctttctttggcttttccctgtggtccccactgtggtgccaaagttatagagcatccaggagcatttcagttcagctcagtcgctcagtcgtgttcaactctttgtgaccccatgaaccgcagcacaccaggcttccctgtccatcactaactcctgaagtttactcaaactcatgtccatcaagtcggtgatgccatccaaccatctcatcctctgtcgtccccttctcctcctgccctcaatctttcccagcatcagggtcttttcaaatgagtcagctctttgcatcagatggccaaagtagtggagtttcagcttcagcatcagtccctccaataaatattcaggactgatctcctttaggatggactggctggatctcctcccagtccaagggactctcaagactcttctccaacaccacaatttaaaagcatcagtttttcggcgctcaactttctttatagtccaactctcacatccatacatgaccaatggaaaaaccatagccttgactagacagacctttgctggcaaagtaatgtctctgctttttaatgtctaggttggtcctaacttttcttccaagggggcatttagattccaaattatcctagaaggtgatttccttagctctggttatggggacctgtaggcaggtgatgcttccagacaaattggccagactcaggcccagtcactgagttgatgcccagcagaaggggaagccgagagaaggaagcgcctcgacaggcaggccggcgtgagcgtggtcagagaagcccctgcaccaggtggcgacgtgctgggaggacagggcccgaggtggcaccagaccggaaggacagagacaagcagaaagggggggcactgccagaagtgcattaactcaaaggcgaagagatgaagtctttgcccttctggtggggctggccctcagctcagccttgctcacaaaaataaagtgcaaatgaaagtgacagtcgttcagtcgtgtctgactcttcgcgatcccatggacggtagctcctcaggctcctctgtccatggaattctccaggcaagaatactgaagtgggttgccattcccttctcttgagtgggggggtgtcttcctgacctggggatcgaacccaggtctcctgcattgcaggcagattctttaccatctgagcctttcaggaaaataggtgaacatctagtgaccttagctgtgatggggagacataggcccccatcaggacacggcctggggacatccagagagtaagtcacaaatcccagcactaatcaccaccgctgctacaattcagggacttcgtaggagccaggcctgcttggggactcttgacaacaatcccgtaaactaagccttagtgttagaagcgccaaaaatcaggagtggggactccagagccaggaagccgggttcaaaccccagctctgccactgactagctatgtgattttgaactagtttcttgatttttctgatcctcagtttcccaatctgtaaaatgggtatgaccaacggagttcctgcctctgtgagctgctctgaaggttaaatgcaacgatccacatacagcatccagcagagtgccgggagcccggggactggaatggcagctgattacacaatgttcctgtttcattagggctccttataggtggattctcagacctgtgctcacgtggctgtatcaggggaggaagaagagcagagaggtgagcagactgacattctctgaacaaagggatgtggatccatcaaaaagaacatgcttttaaaaatgtgcttccgtgttttcccctgcgcacactttaaggacagtaactacacctacaaacagccttccacgtaaccatggaactgcagacatcgaaccgcacagtagaagcaccccaaccttcctccttgcagggagactgtctgcagaggacgagagtttctctttggtgaaaaaaagaatcatccattcagaatgtcaataataattatactgagggagggaggaaagtaggggaggaagaaaagcaaaatccttcaaagcttattatgatgctaaagtgcaaatttgtgtgtgtgtggcctctctccccggcatgtctcctgcacacagttgatcgagctttacgataaaagccaccatacccgagtatatacgtactatgcttccaccctttgggttgagagtcaaagcatcctatacaaaggtcgtcattttgctatcagttgtagaaagagtaggagccatctggacatgggggcaagcatatgccggtggatgcaagcaggaagcaagagaacttccctggtggtccagtggttaagaacccaccttcctacgcaggggacacaggttcgatccctggtctcaaaactaggatccaatatactgcagggctactaagccccttgccataactgctgagcccaggtgccctagagcctgcacgccacagctagagaagcccgtgggccccagcagtgatcctgcatgatgcaactaagacccaacacagacaaatgaataatttctttttaaaggacagaactgaaaggaaagagaagtaacccaaatgggatcctatactatctacattattttgtatcatataagataatactgaggtagatactgacagacaattcatcttataagcaggtgacgtaaatgcatgatgcgaataaacacagtatatgactgtaaatgtatttttcattccttatgattttcttttctctttattttttaaaatatttttattatatttgatttatagctctgtgtgagtttcacatgtacagcaaagtgaatcagttatacacacacctatatccattcttttttcaattttttttcccatataggctactacaaagtattgagaagagttccctatgctatacagggtccttgattagaactcttggtaggtccttattggttatttattttcttacgattgtcttagcaacattttcttttctctagcttaccatattgtaagaatacagtatataatacatattaatataatgtacaaaataagtgtgagttgactatgctattggtatggcttccatttaacagaaggctcttggttgttaagttgtgaggagagttaaaagttttatgtggaatgttggctgcgaccctgaccctatgctattcaagggttaactgtaacatgtttatatgtactcaaaataaaagcaagtgtatttgtaattataataatgtttgtacatatatgaatatatttatttaaaatgcatctgcacagccttcctccagtgactagtgtccaggtacttcagaggcacttcagaaacactggttgagtaagtgtctgtaggtttagctgtgggtttaggattacagtcccaagcacggagctccctgcctgtcatccttaaggcccaggcagcagtgaaatgtctcttggcccacatgcaattcagactgtgagttcctagaaggcaatgcgtgctaagtcgcttcagttgtgtcagagtcttttgcaagcccatggactgtagcctgcctagctcctctgtccatgggatttcccaggtaagaattctgcattgggttgctatttcctcctccaagtgatcttcctgacccaggtatcaaacctgagtctttcacatctcctgcatcaggaggtaggttcttttaccactagtgccaccttcgaagcccaatccctagagggtcattcagttcagttcagttcagtcatttagtcatgtccgactctttgcgaccccatggactacagcacgccaggcttccctgtgcatcaccaactcccggagttcacttaaactcatgtccatctagtcggtgatgccatccaaccatctcatcctctgcggtccccttctgctcctgctttcaatctttcccagcatcagcgtcttttccaatgagtcagttcttcgcatcaggtggccaacgtattcgagtttcagcttcagcatcagtccttccaatgaatatttaagactgatttcctttaggatggactagttggagttccttgttgtatgtggccaactagtccacattgtccacatggtaaatttttagacaaataacgcagcaagaggagctcatgactagccaacgctgtggccaaggacatagtctccaggagacagatgaccagacagatgaatctctgaaagccccagggtcatgggatacacatacacattacacttgggagaggagcctgaagggcagggtgggtcttcattggacagttactttcatccctcagcaaagcacactggtgcccacatggatgcctgagatggagccaccgttccccaggctcaggctgataattcagcatcagacaaagttgcatcagagacctctgactgggggtcagggctggagatggcctctgtcactctttttgcttctggctgagaaatgctgctctgtgcaggggtactttcagcaccttgcagagaatcatgggctgctggggataaaagcctcccatccccaccggaggacttaccaggcagctttagcccaggggagctcagagaatctccatctctttatcttccttcttccttccccttcccgcttccccacccccaagacagcagggtgggagaaagtcatgcattaaatgtttggaaaggattagttcataaagacagatcagatggttagctttggggaagggggaggaggacaaagctggatccttcactttaacctagactaaaattaattccagatggcttaaagaattaaacataaaacatggagccattaaaaaaaaaaaaaagacttcaaagtttcagtgggttagaggatgatcccacagatgaatttcccaaacataaaaggaagggaaggagtcacaaagaaagaattgttggatatgaatacataaaggtacataaaacttctccacactaaaaagttacctcccaaaaattaaagggcaagttgcaaaatatctgcaagatataggatagtaacataacaatagagttaatattattagtgtttacagaattcttacaaaagaataagattcatttcgatgtttggcaaaactaatacaatattgtaaagtttaaaaataaaataaaattttaaaaaaagaaaatagaaaaaatagcaaaatgggtaagaaatgcaaatatatatttcataaaagaaatgcaaatggataatatacatatgaaaatggtaagaaaaaacagctagaaatcaaataaacatgatttaatccaacaacaaaatagcattttacttagcaaaatttggaaaattttgttctaaggatatacttctgatcatacgttaccataaattagtgcaacttctctggaaaagcaagtagcgataagtgttgctgttgtttagttgctgtgtcgtgtctgactcttttgcaacgctatggaccgtaggccaccaggctcctctgtccatgggatttcccaggcaagaatactggagtgggtagccatttccttctctaggagatctttccagcccaaggatcaaacccccgtctcctgcttggcaggcggattctttaccactgagccaccagggaagcccaaatacatgcctactcttttaaagacagttcctgcttttggaatctattgtaaggacataataaaaggctaaaaacgtggatgaagacttgcacttaaagatattctgtgtggcatttataacattgggaaattgagaaaagcccaaatgtctatcggctgggaattcacttgaaaaaggcacatccgtgtgatgtggtatcaactaaccaaggacacccattgttcaacactaaatgaatcacactatccctttagaaccctgtatacaaataagatcccagttaagagtgtctgtctctttctcccccatttctctctctgtctctgtctatccttctgcctctctgtctctctgcatttttctatttctctctctctctcacatacacacaactacaaggaaattaaccaagatattaatagaggttgtctctgataggtggggcttccctggtggctccgatggcaaagaatccacctgcaatgcaggagacccaggttcaatccctgggttgggaagatcccctagaggagggaatggctacccactccagtactcttgcctggagaatcccatggacagaagagcctggcaggctatggttgataggggtagcaaagaggtggacatgactgagggactaactcactttctgatgggcaagtgtattaataatttttctacttcttaaaacaagtatataatacttctatgatcagaaaagtaagcatacatattataaaaaatacgtataaagaaaacatacatgtttaaagaaatatataaagaaaacttacatattatgaattacacagtgagaaagaaccccgtctcataagagtatgttgacggcatgagttctgctagctgtctgagtgcacacttacgtgaccatggatgtaaccacctggataccagagccatggttggagtattttaatagaccacagaaaatgatggcaatctaggattccagaaaattcttccacgggggacttttgtagaaaccaccatcctgagagtcaccctatgtgcactcacacccctgacctttttgaaaaactgtcagaggaagtgcctcaggcttgaggaatgacagtctagagccttggtcagcaaactgtggcccaaaggtcgaatccagcccaccttctgcttggcaccaccacaagctaagaaccatcttcatgtttttcagtgattatgtaagtatctccataatattctcacagtctgactcttaaagcctaaaatatttactatcttgctcttctcccaaccttcacccctcccgtggtgctcggcttacctgcagttggaacctatggacaatttggtcaaatactagaagcaattttcaaaaagtagtgacttttttgaaaactaacaggagtgacaatacccatggtttggaagaacatgtaagcggggaaagttatcctccggtactattgggaatggcggaacttttgcatccctttctttatggtaatttgaaattgcacagcaaaaagcctccactaatgcaagctcatttatttagcaattccatgtatcagaatttattctaagaaatattgtatatgtgcacaaagatctggtgcacagtgttcaccgaaacattccctgtggagctgaaaaactgcaaccagtctcaatgtcccgcaatcagaaatttgttagacatccattgatgtaaaattatgtggccctaattgatagatgtgaacatatgtttatgataaagtatagagtgaaacaaaatagattggagcgattgcacaatataagcccacattttaccatcattagcacacatgaaaaatcctctagaagaatataaacaaaaatgctaagagtgtcatctctgtgtgatgttactgtggatactttttattttctccttttctgtatatctggcccttaggatttttaatacaaggaacatagattatttgtgcctctgctcccttcccaagcccacatcatgacaaagtagacccaaaactcataaacatactgtaactgagcaggaccctatggggccttcccagaatagacaacccctacctgccacatcctccacgtacctcttgtggaggtaacctacctcatcgggagataaacttagcctcctaagccttccctgagttccaaagagtaaatttaaccaggtaagtgagaaaaggcagaaggaaaggaaaagtcaagcaagacaaaatagtaatagtttagccatttgtctgtctaaagacagagataacatcttgaatcatatcctttgaatggttttgcaaacactgaaactcccaccagctggtagaggttaatggcatactgtctataagcatgtagatcccatactggttggaaccagaaggttgataatgttgattcctcatttcttcaccaccaaccaatcaaaaaatgttcatgaactgattacacatcccacaagcctcccttctctagccccatctttaaaatctttctctggaagcatttagggagtttaggctttttaagcactagctacctgggttccttgcttggagtcagaaatatacgttgcattttccttgaccacaacctggtgtagatcggctttattgcatgtaggtaaatggattcaagtttggttcactaacaatataatcttaccaaaattttctagaacgtcttacagaagtgtacaaataccgttcagaattgactttcatctaggttgaagtgaaggatctaactttatcccgctcatcactacccaaggccaaccaactgatctgatcctttgcaatcttccttccattctgtgtgatttaagtttaccagaaagcgccaagattctattttcttttgctgcaaaacatgccggaaatttagcagcttgaaatagcaccgttttattacgcgctcaggatattgccagttggatagagttttgtgtggggactttgtttctgctccatgtggcaccagcttggtaacctgagcagctagggctgtctggtatggttcagcttggttcctatgtccggggcctcagctatcacacttgggatcggggtggcccctattctccatgtggcttcttcacatggttagcttggccttcctttcgacatattcatctctgggcatttggccctcttacatggtaactgacttccccagagcacaaaagctggagctactttacttttaaaagatagagacctagaactggctcactatcatgcctgacacactttattttttcacctttttaaggaaggtccaggccaacccagactcaagggaaggggacactgggagggacctgtatttattagaagccaccaaagaaacaatctcccacactcagcaattacaggaatattttagcaagttctctggaaatgtgcactgactgattactaatgattcctattaccatatataggaatttttaaactcagcaatactgggaaagggtgatttattatatattttactactaatttgcacctctcatttgacatagtgtgtgtttgattggctcaaatatcttaaaccaactacttttatatatgccactcaacaaggtaactgtcattaaaatatcaacacctacttatcattcccttaaaagcaaataacgacatcaataaatttgagttcacatactgcttaggggccagacttttttggtaaggttcaagttaggctaagtattatgttgaccaacgaattcattccagttttccacaaggtgttatggaaaaaccagaatgaacttgttgtccaacccaatattttggaaaaagttccaaaaacttttccacctagattgacatttatcacagattattaggaaggactaacggaggctatggactttctagatggttcagtgggtaaagaatccacctgcaatcaggagatgcaggagacatgggttcagtccctgggtcgggaagatcccctggaggagggtatgacaacccactctagtgttctggcctggagaatcccatgagcagaggagcctggcaggttacagtccatgggattgctaagagtcggacacaactgaagagacccagcacacacacaagggaggctgtagacattcagctgaatttgaatgtctggttgtggtgagcaggggatatgtggtgagtagaaggaagtgtggaaaactggagggtcaaccgtgaaatctcttgacctccccatccccaccatctgcaccatctcctccaggatctctgtttttcttttttaaaaaaaaatttattttcaatttaaggataattgctttacaattatccttcaagtaaaacccttcaattactcaaatgctttctttttatggctaagtaatattccattgtatatatgtaccacaacttctttatccattcatctgttgatggacatctaggtttcttctatgtcctagctattgcaaatagtgctgcaatgaacaatgggatgcatgtgtcttttttgattatggttttctcagagtatatgcccagcagtggaattgttaggtcatatggtagaaatggcaacccactccagtactcttgcctggaaaatcccatggatggaggggtgtggtagtctacagtccatggagtcgcaaagagtcagacatgactgagtgacttcactttcacttttctttcatggtaattttactcctagttttttaaaggagctccctaatgtcctccatagtggctatatcaatttacattcccagcaacagtgcaagaggattccttttcctgcacatcttctccagaatttattgtttgtggattttttgatgagggccactctgactggtgtgaggtgatatctcactgtagttttgatttgcatttccctaatagtgagtgatgttgagtatcttttcatgtgttttttagccatctatatatctttggggaaatgtctgtttaggtctcctgcccactttttgactggcttgtttgtttttctggtattgagctacatgaaacacttgtatatttttgagattaatctttaatcagttgtctcacttattattattttctcccattctgaggcttgtcttttcactttgtttatagtttcctttgctgtggaaaagcttttaaatttaattaggtcccgctgtttatttttgttttttatttccattactctaggaggtgggtcatagaggatcttgctctgatttatgtcatagagtgttctacctatgttttgctctaagagttttatagtttctcaggaccagaatcttgcttctcagcttcctctgctcctcgcttctgtatttgtgacctctctttgtctgttagtcattgccaaaatattataaaactcaagtccatctcagattaagactatacgagcaacacatacttagtgatcctcaactccttgtatccaaccaaaactattgccatggctttcttcttttctcatgcgcaaccccggacagaagagcctgtgcttgctgtctgcccttccccgcctccagcctcacctagtctgcaattccccctagaggtccagacagagctcacccatgaccactgccaccaaatccacaatgggctgtcttcacctatgtggctgaacctctctaaggcacagaacaccttgatccttcaatctgttcttcttgggcttagtttttagagcttagttctcttcccatctgtcagaccagcttccctcacaggctcttttttttttttcctttgcctacacctctaatattgaagtgttatacttgaccttctttttgcccttgtttgttccagaccagaagttcttaatcttgcatcccagacttcattgtgattctggaaccagaaacccccatgaagaattttgagtgtgttctttttctcactggaaggccaaagcttttagtagattccccaagagtgctgtgacctgtaaactggagtgagagagaaaaaaaaaacattgtcttcggtcatttcacttgctgtcctgacttcatccatcctctgcagggtgaagatttgtgaatcttcatctccagaccctacatctttcttaagccccggttctgtgtgtccaacctagagttttgttgttgttgttccattgttcagccgtgtctgactcttggcaacctcgtggactgcagcacactccaagcttccatttcctttgctatctcctggaattacagttcatagttattcttttgtccctcatatttgactctatatatccaaaacccaatccattatctccccctgaaacctgaatcctttttccctcttatcaaagctcccaggctagataatgctctctttccatgtcaccacattcaattggtgatcaagccatcagttctactccttttatatcattactggtcctgtgtctttctgccatctccaccacattgccttggttgaagccaggagttgatcaactttttctataaggggccaaatagtaaataatttaggctttgtgggctgcgggatctctgtcaaaactactcgatgctctcattgtagctcaaagggcatcatcctaaataataggcaaatagggaaataaatgtgctgtgtcccaaagcaactactcttgggtactgaaacttgcatttaatataagttttacatctgacaatatagtattcatcttttgatttttctcagccattgaaaaactgtaaacccactccacctctttttttttttttctaattttattttatttttaaactttacataattgtattagttttgccaaatatcaaaatgaatccgccacaggtatacatgtgttccccatcccgaaccctcctccctcctccctccccataccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcctcccctccccataccatcctttgcacagatgggcaagccggattggaccgcgggccgtagttcatcagctccgagcttgtgccatcgcatctgtttcccaaagccctctctccttgtccaggactcccgcctcagctctgctcctatggtgcgcctggaaggtcgctgtgtgtgccactctccagctcaaaccctccgacaggcccccagtaacctaggaatagggtttctcagccttggctgtattgatactcgtgtgtgtgctcgctaagttgcttcagtcctgtccgactctttgcgaccccatggactgtagtccacaaggctcatgtgtccatggagagtctccaggcaagaacactggagtgggttgctgtgccctcctccaggggatcttcctgacctagggatcgaacctgtgtctctttgccactagccccacctgggaagttggggctggacagttctttggtgggcaggagagagctgccctgagcattcaggatgctcaccttcatcctacctggcacatggcagtggcacccctacctccctggtggtgacaatcaaaaatgtcttcagggacttccctggtggtccaatggctaaaactctgcattcccagtgcagggggcctggggtttgatccctgagcagggaattgatcccacatgctgcaactaaaaaattcttcttagatgtctgcagatactgggaaatacccctagtgagaacccagaccttgaggacaaagccaaagcagagcgcacaggtctttcccagctcagccctcccttgctgcccatgctctaactgcattgggctgcctatcattccccaggatgccacacttcccatccctctgctctctccacaatcccctgccttcctgccccgtggggtaaatgcccactcacattccacatttggtgcaagcttggcatcttgacatagtgtggagatttgagcttttcctgtattgtgtccacatggtcagccctacatacttctgtcaaagcccctgaagtgccttgtccagccctgggttttcaacttggtctcccaccttagactgtgagccccttgagagctcgggtggggcctgattcctttctgtagcctcagcaggtgattgaatgaatacatgggtaaactgaggctcactcagcacccctgatgggagagcccaaggtcatgggttttcatggtagtgtcagagccagaagacccacctctaccctcaccctgccaggtcgacccctgagcctcggctgtgggtttagatagctgaagactttgtgctttggagaaggaaatggcaccccactccagtattcttgcctgtaaaatcccatggacggaggagcctggtaggctacagtccatggggtcgcaaagagtcggacacgactgaacgacttcactttctttctttgcacttacaaatgaataggaatgatttcagatgaaaaggataaatgggggaagacagtttggactagtgttgctgcgtccaagaccatcgaccagctacgaaagctctgggattcccgagctgtggcagtgggtaaggacacaagggctgacggcatgtgacagatctctgcagaccaaggtgaccttaggctcatcgaggaccggtatgtcaaggcaaatgggaacataaacccagggtgcatacagatcccaggaacctggatcctaggctgtcacagaggattttctagctgctgtgagctgagaaaaattactataattaacctatgctgaagaataatattatgacacatgatttttgcagcaggctcttgagcacttcgaagccacgggcagacacactgcctgtggccgtcgtggactcctgagacaagcggctctgaaggagttctagaaaagcattcacagtgccgaggcagtgagcatctggtttttatttaagaaacctgaaccttaataaggcatggaagttgcccagagaattataaaacaaaggcaagaaagtgactagtggcctggaccctatggggcccggggagagtcctgcttgtgcttctgaggggggcagagcctcgggcagaaggcatctagctgcaatttcctccacccaacaccctaagcccctgatgtggacacgacagatggagctcattcaggatgctccttctgcttgagtcagaaccctctatctcctcctgagcgtccctcccatgtgtgcaaaccaccatcaacctgtgcccagggaaggaatcggggaagacggagtgctgtctccattccccagacactccctggaaagtgcgcggtggaaggggcagaccagactctgactcctggtagctagaagtgaggtggcaaccatctctctccactgcccaccctatagaggaggcgcctgagctcagggacagaacccacccagccagagaagtcaccccttagaatgggattgagtggattctaaggctctgctttctcccaaatgcgcagcaataaacggcgggtcccttaaattatggtatttccccaaagtggagaaccaagcaaccttcgagagaacaaggcgacatgtgaacggctggtacggaaaaatcttcaagacacgctgcaaagtgaaaaaagaaagcaaagtgcagaacttccacaagcaaagaaaggctgaaacacacgaatttgctgggatgctgtagcaggttaaattgtattcccaccaaaaacgtgtccaagtgctaacccccagtagctatgaatgtgacctatttgaacataaggtctttgcagatgatatcaaattgaggatcttgagataagatcatcctgggttcggaatgggccctaaatcttagttccccagcccttggcagtgagagcatggaatccgaaccactggaccaccaggaagttcccagggagggagcttttttttttttttaaagagaaagtgagactttaaagaattatttatttttgcctgagctgggtatccattgtcacagagcgtgggctctagagcccaggctcagtagctgtggtgccccagcttagttgatcctccacacatgggatcctcccagaccaggatcaaacccatgccccctacatttgcaggtagattctttttctttttaagccccccctttaaaaaaaattacttatttttaattggaggataattactttacaatgttgtgttggtgtctgccatacatcaacataaatcagccataggtatacgttcgggtgtccctggtagctcatcttgtaaagaatccacctgcaatgcgggagatcttggtttgattccttggttgggaagatcccctggagaagggataggctacccactccagtattcttgggcttccctggtggctcagacagtaaagaatccgcctgcaatgtgtcagacctgagttcaatccctgggttgggaagatcccctggagaagagcatggcaacccactccagtattcttgcctggacaacccccatggacagcggagcctggcaggatacagtccctggactcccaaagagttggacagggctgagcaactaagcacagctcagcatacctatgttccctccccctgcacctccctcccacctccccaccctccatcccacccctccaggctgtcgcaaggtgcctggttgagctcccggtgctatagagcaacttcctgttagctctctatttgcatacggtaatgtatgtattcagtgctgttctctcagtcgtcccacccactcctttccctgctgtgcccataagtccacaattctcttcatctgcatctctattcctgctctgcaaatagattcatcagtaccatttccctagatttcatacatatgcattaatatacaacatttactttttttctttctgacttacatcactctgtataataggctctaggttcatctacctcactagaactgactttgttccttttcatggctgagtaatattccattgtgtatatgtttcacaactttttttatccattcatccgttgacgacatctaagttgcttccacgtcctaactattttaaatagtgctggcaggcagattcttacccagtgagccaccagggaagtccaagagagacctttgagacacacagagagaagacatgtgaaaacgggagcagagattggaattatgttgccacacaccaaagaacatttggggctaccataagctgatagaggcaaggaacgatgttcccctacagacttcatagggagtgaagccctgatgacatcctatatttagacttctggcctccagaacatgtgagacaataaatttgtgctgttttaagccactaaatttgtggtcattgtttatggcagccctgggaaacaaatactgatgctaactgataagaatatttttagtcccggcgtgccccgcgcaggaagggccggagtcgacaataacaaacccgtggcggccgtgtccgcggccctaccgagcccggcgctgcctctggttccgtcgcccggcccctcggctctgaccggccgcggctcgcccttccccggcccctgacgcagagccgaggggcctgcccgtccccgtgcctggaggtggctgcctcggcggcgccgaaaaaaaaaaaaaaagaatatttttagaagttaatttagattttattgaatacaagatcaacataagaataatcaacaaataattagaaaataaaagacttaaactctatcatttataatacgatcagccaagttaaatacttaggaattaaatataacagaagacatgaaggacttccaaacagaaaaaataaaatactcagaaaaataaaatacccagtaaatttacttacaaatttaagtaaagatttgataagtgaaggtatatattaagtttatggattggaaggctcaggaatgtaaagatatcatgtgtgcgtgctaagtcacttcagtcatgtcccattctttgtgaccgcacggacggagcacaacaggctcctctggccatggggattctccaggcaagaacactggagtggggtgccatgccctcctctaggggatcttcccaacccagggattggacccaagtttcttatgtctcctgcattggcaggcaggttctttaccactatcaccacccaggaaacctgcaaagatatcagttctctccaaatggattaatgcagtcacaatgtaggttacatgaaaccacaatcaaaatctatgtagatacttgtgaaaagtgttaagttgattctaaaatatgtgtgaaagttcaaacacccaggaacagccaaaaccatcctaaggaactacaaaacagctagaacactagccctccctggacaagcaagacttggactccctggacagcaagactttttaccaagctagtcattaaaatagtgtgttatcagcaaaaagacagccaaacagaccaatggaacagaatagagcacccagcagcagaaccacatatcaaagaacacttttgtttttgatttataacaaaagatttgcaccagaggggaaatgggggcttttcaatagatggttcgtggtcagttagctatccgtggggaaaaatatttctcttgccagcctcctcacaccgtacaaagaaatcaattccagatcaggtttaagtgataacaataacaattttggaaatgcaaccggggaatgtcttcatgacattggagtcagcaattcaagacacataaaacaacaaccattgtagaaaatattgatttactagatttcaccaaagtagagagcttctgttcatcaaagacactattaactatttagggacttccctggtgggccagtgggtaagaatccggctgccatcacaggggacacgggttcagtccacggtctgggaagatcccacatgccgaggagcaactaaacgcgtgcgtcagaacaactgagcctgtgatccagcgcctgtgctccacaacaagagaaaccagggtggtgagaagcctgcacactgcaaccagagagcagcccctgctcatcactcacaactagagaaagcccaggcacagcaacagagacctgggcagccaaaagtaaagaaataaaaaatttataagatccctactaatttaacaagagcaaaagacaacccaaaggaaacgatgagtaagagtcttgaacaggcaggcatatcgtagaagagcctattctaagaagcagtgaaaataaataatatcaataaaaaaataactttgcggtaatttgttatggcaaccctggggaactaacatagatggccaagacattttggaaacaagtttagatctgaaattccctgtcatggatctgctgctgagatcacagccagaagactttcagttaggtaaaaaaataaagtaaaataagtgaaaattaattactagtggtaaagaatgcgcccgcctatgcaggagactcaggtttcaagcctgggtcatgaggatcccctgaaggagggcatggcaacccaccccggtattcttgccaggagaatcccatggacagaggagcctggcaggctatagtccacggggtcacaaagagttggacacgattgagcggctcggcacacatactgtttacccaaagatatgaacaagaatgttcatagccacattgttagtaattactcaaaaatgaaaccacccagatgtctgataacaagaggatgaataaattaccatatcttcatatgatgaaacgctagctaagaatgaaatgaaagcagaacaactctaagcaaaaccaaattgcagagggaaagagacccagctcagaagaagacaagtataagatatttaagcactaaccaacctatggcattagaattagagtagaggggaggaggtggcattgggaggaagcctgaagatcttgctaaggacccctttcttgccctggggtgtggttacgttcacgtgtccatttgtgatcattcatcggactgtacatttctggtgtctgtgtgtaaggtacactttcatgtatgtatcttagatagcaattaacattttcttttaaagtgttttatccaataaaaattaatttacaaaaaactttagaaaagaccagaaaagcacagacattcaaacacataacaaatttcaaaggcttggaaaaaatgttgctattggaggaggttactttactgacaaaggtccatctagtcaaaactatggtttttccagtagtcatgtatggatgtgagagttggactattaaagaaagctgagcactgaagagttgatgcttttgaactgtgctgttggagaagactcttgagagttccttggactgcaaggaggtcaaaccagtcaatcctaaaagaaatgagtcctgaatattcattgaaaggataccgaaactcatgttccaatattttaaccacctgatgtgaatgaagaactgactcattggaaaagaccctgatgctgggaaagattgaaggcgggagaaggggatgacagaggaggagatggttggatggcatcaccgacttgatggacatgagtttgattaagctccaggagttggtgatggacagggaggcctggcgtgctgcagtccatggggtcacaaagagtcggaaatgactgagcgactggactgaactgacggaaggaggtagaaatgaaagggcagtgtgatttttttaagagaaatgtctgattacacccctttctttgtcttttccttcttgctatgcaactttagggaatagaagctctttcaatggggagagaggaggggtgggagagaaggagagaaaggaaatatggggagaaaagatgagcgggagatataggaatcaggaagaacatctcttgcacctcctcaaacctgagtcctttggctaccaggcatcattttaccagtcagtctcttaaccaccatgctcggctgagttgggcaatgaggaggctggatccagccacaaacaaacacccccaagaggggaagtaagcacttccagaaagaaccgttaggggctcccaaaagtggacctggcgtgttccttccgctctggctactgctgctctggcaggagccctgcctctccacaccagcctggggccccagccccagcggggaagaaggcaggcaacaggctcagccccggggccagcaggctgcatgctgggctgtgaaaactgctgcccaggagggttctgctgaggtgaggccccgccaagaccacagcccgaaggcccctgcagagggcagagggggccagcccagctacagccgcaagccggggatctcgtcatttcctccttgtccaccatcacctcttctgcttcctttatattatctgaccttgcctccactagaatgttagttccgtgggtccacaggcctcatggtgaggcttttccatcagctggatcctgagcacctagaacagcgctgcaggcatcgtagcggctcagtagatgtgtactcaagaaatgtgaataaacgcaacacagtacacacacactttcaaataggctcagatcttcaggtcactctccaagttcacccgggcgcttttctggcctgctctgtaccaggaggtgggctccccgccaacaccacccaggccctcttggcaggtggctgctgtcactgcagcagtaaaggaaaccccaggagcgcagagggtgggggccagttgttctcctccccttgaccaggtgatacacttcctgccctccctccaggcccagagagggaactgtgtcctctctcatcagcatctgggaaccacaccccaccaccatcctaccccactcccatccttggtccttccctcatccctccatgactcaggaagctgaaccttcatgacagtctctccatctacaccatttgggatgaagtgttgctggaatcccgaccgataaaccaggcaactctcctattcaacgtgtttgttgctgtttagttgctaagtcgtgtcggactccttcacgaccccatggactgtagcctgccaggctcctctgtccatgatctcccaggtaagaatactggagtggggttgccatttcaatgtgttggactggccaaaaagtttgtttggattttccataacatcttacagaaaagcacaaagtttttggctaactcaatacacgttagggtatcttttatatatatgcagtgtgagcatgaattttctttctctttttctttaaacatttttttaaattttgcgactctagttttgaatcatgctctgttaatgtcatacaaactaaaagcgccttgtttctacattgtggttgtatgtgtgtgtgcttgccatccagggaaaacttttattataattgtgtaaaatttagagctgtctaaaaaaaaatgtcttcaacaagacagaaaagcttcaaaaaatgacaaaataagaaaaaaattgttgcaaaatgctaactcttcaaaattaacctatgaatttaggactaacctaataaaaatatgttaagcttgaattgagtgtcatgtagggttttttcccaattgtttttaaaaaacttaatcaaaatttcttcagataaatgttacttgtacagacttctaataatattcatggcatacaaaaccatctttattgttttaagcatatccgtgttaaacttcagtgatgatcagaataataacgggcctttttatttaaatcaaaattctatggcaatacgtattctaatgcgtgtgtctgtgctaagtcacttcagttgtgtctgactctgtgtgaccctgtggactgcagctggccaggctcctctgtccaggggattctccagccaagaagactggagcgggttgccatgccctcctccagggggtcttcctgacccaaggatccaacctgcatctcctgcactgcaggtggcttctctactgctgagccaccagggaagttcaatataatcataagaattatgttaagaatatatgaagaaaaggaataaataagaattatattacataagtctttattttaaaatactagaatatctccttgaataagagccattgtggcatcagttaaatattagtcgctaaactaaaaagagaaacatcaaaattaaagggaaagcatatgcagaagctgagctgcagttatgaggattcagcacctggcttctggggaagctgaaccaaacctgcaggtgacctcagaccccggaaccctcaccgcatgaccctcctgctccctggggagcctggtgacctgggggagggtgccctgaccctttggggcctctgtgggctgcgggtggagcagcagcaggagcacgcgggccccttgggaaaggctggaacttgcagtggagcttggccagcatctgcctcgtgtggtcgctttctctccttagctccctgagcctcctctcggtagacacagctgccatccccagtgcttgagcccgtttctcatggacacagatctgcttttgatggtagcagttggttctctccagttctttgcccagctcctccgccatcctcttatagaggtcacgatcctcgctcaaggatttcacagttttacacaccctggcaagcttcttctccatgtctaagcagggcagttccccctcaagacattttttctgaagttgtgctatgtaatcttcaaacgtttggggcagaacttgaagctgcagccttagccgccgaatctctctttccagctgtgaattctcatcccacagagatgcttcttccgcttcaagacttgatatctgtcctgaaagctcttcattcctttgcctttcttcccacagtggttgggctatttctttaggactccaaagggacccactgaagtcagcaccactgatgacacctttcagatcagcttctgatcgatggatgggtggaggaccatattctgcttccttctttcgtgggaccttgaggttcccaacctccacgtgatgtctgagggggtcaagcaagggactaatcttcagcacgtgctcagccatcggtgtcagtaggctgagcttaccattcaggacctgttccatctgtgacttggaccgctccaaccttttattctccttcattttctggactctcattttccatctagcaatttcttgggtgagcagaactgaaccttctggaaaacgagtgatcttcttcgaatcaaccattttcttctgagattcttctccacccttctttgatgctttcgagatgggttttccatcagtcacttgggaaaactgaggaggctgactctcttgtgccgttttcagaaagtcaacattgcccctaaatgaggacttgctctgcattgcattcatgcccaaccaacacagggtttgtaagctgggaggactggcctccaccccaggggacctgaggacttcatcagcttgtgccgttggtctagcattcccatcctcactacatagtccacagacttcattgtgggcagaaccctcttggcccagcaatttcgcactttttaaagtgtatcgcctcttcactatcaaatctatcatcacactacgtaccatggtattccagagaaagatagggtgattcaggacattggtcaagttttttgaaaccaccagaagaacaccctgcagatgctccaggatcagctggaaagtggatccagaggcaggcagtaggctttccatggcttcacagctccgcgtctgagagccagtggtcatatgagccacaactgaccgctcagaaccctgcggagtgtcctgtctccaaggtgagcaatcgctgtgtaaccagggtagatgagttgggtgggggagggggaggtaccagccaggttctaggaaacagttctccctaagtgctctgaaacaggaagagatctcgtttatgcaggtcctgggggacgtggcagggtctgatcagagcctggaggtgggccactctaagccccacctggacctacagcaagcccggggggtccaagcagggccaggctgtgtctttttccatatacaagagcacactggcgcaggtgggtggagctctgtccccaagcaaagtctattctcctcatttaaagtttcttatgcagagaagcctgtcctgccccctaaaggtcccaaggatctctcttttctgtggctccctctctcttttgtctgtggtcactatggacagacaggcagggccaccagatcaaaaggtattaatgaaaattccaatcctaacagctcaggaggaatcagttgcaactggcaaggtctttgttttttgtttttgttttttaattggaggctaattactttacaatattgtggtggtttttgccatacattgacatgaatccgccacgggtgtacaagtgttccccatcctgagccccctcccacctccctccccattccgtccctcagggtcatccctgtgcaccagccctgagcaccctgtctcatgcatcatttgcaactggcagggtcttatgaggtcaaagatttcctttggcatcagttttgtgcaatccaagtgttcctgggaggggtggatagggggaaatgactcaactccaggagtgagacagggactggaagtcttcattttcttctttaatcaaagtggccccaaggagtctccaatccactgagtcctcttcagaagtgggcctctggggagggaggagccctccctctggctgaattgcccccttttctttcattaaaccacatctcactcgcctaacatctctctggaagaccagagaggggcctcagattccccttgtgtatccctgggactctgtcatgagcctcttgtccccagtccctctgtccaagatggacacaacggaactgtcagccgaggccagtctgggggtcctgaggggtgtcatagggtgttcagttctcaggggctccatggatggagagaggtgaggctctgatcaggctgtgatagagggaggagagggccaagtgctcacagtgagtgttgtttcagttttaaaattttaattttaaactgtttttaaagagcagattgaagatcaaagaaaaattgagcagaaagtacatagattttacatatatgcctttgtctccctgcaaaatgtcccctactatttatatcttatgttggtgtggtacatttgtgcaactgtgaaccacactgatttattatcattgactacagtccagtatttacatcagggttcactccttgtcctgtgcagttctgtaagttttggcaaacgggtaatgccttgtatccaccaacacagcatcatctatagtagtgtcacagccctaaaaatccactgtaccccacttactcatccctcactctctcctctggaactggtagaaaccactgattacttccttgctctcaagtttgctttgtctgatatttttatagctactcttggctttcttttaattaacgttaacacggtatatcttccttcatactttttgtcgttgtgtagttgctaagtcatgtccgactctacagtcccatggactgtagcccaccaggctccactatccatggaatttcccaggcaagaacactggagtgggtggccatttccttttcccttcttcaggggatcttcctgacccagggatcgaacctgcatctcttggattggcaggtgaattcttaaccactgagccaccaggaaacccctttacttttcatctaatgccttaaaaaaaaaaaaaaaaagtattgattgatttggctgcgccgggtcttagtttcggcttgcagaatatttggttgcagcacgtgcactcttagttgtgacacatgggatctggttctcggacctgggattgaacccgcggtccctgcattgcgagtgcagagtcttagccactggaccaccagggaagtccctctaattatgtctttaaagtaggtttgatgtagaccatgtatagctgggtgttgttttttgattcacacggatgatgtctgtcatttaattcatgtatttggaccttagattttaaaatgattattgttatatttagacaaatacatttattgctattttctgttcattgtcttttactacatttttggtctttcattcttttttgccttctctgaggttttcactgagcattttataggataccattttgtctcctctcttagcgtatcaattctacttctttttaaaaggtatttagcagttgcccttgagttgcaatatacatttatagctaatctaggtccaagttcaaacaacattacaccactttatgtgtagtacaaacacccccgtaacagagcattcccaattcctcttttccacctcttataacactgccgtcactcattattacttatccataagttataatcatatgatacactgttgctattatcattttgaacaaacccaggtcttccgcatttcaggcagattctttaccagctgagtcacaagggaagcccaagaatactggggtgggtggtaacctatcccttctccagcggatcttcccaaccaaggaatcaaataagggtctcctgcatcacaggcggattctttacccattgaactatcatggaagcctgttaaatcgatcaagaattaaaaaataaaatattttattttactttcatttattccttcttaacgctcttcctctcttgtgtggatctgggtttctaacctatatcattttccttccctctgaagaaattcttacaacaattctaacgaggcaggtaagtgtgcagtaagtggcagctgtcattgaacacgccaggccaagtgtgggcaagacggcccgacacgcagccgaccagacaccaagcatatcttacagtcttcaaagcaagcgtctgagcacgacacgcatagccggtggcttctttgtgtggcccggctgtgcgtctattaataaagcaggtgtaaaccccctttggccagaggatgaatcaactcttagcaaccacaatagactgctcacatttcaaggcagaaccaactcaactctttttcaatgtctgttcttgacacgaggcactgaactctaccatgactttatctgaaggcagcccaaacttggctttctcataaaaagcaaagccaaaaacattaaatcaagagtttctgtgaccacaaagagcagaatatattctgtgggtggtaataagaggataaaagacggtcagggggacccagtcctgggatatgatgtggcagactctgctggctgaatcattggtactctttccagttacttctttgctggggaaaaaaaaaataaatgttttccagggtgagtggctgggagcaggggcatgtaggaacactccccctacatggtgagtcacaactggctcagcctgtctggcaatcacctcccccttgaccagtgattggtctaagagtgagcatgtgaccagcagggccgaccaatgagacataaggaaggatctactgaggacttttggaaaagttatttcagttcagttcagtctctcagttgtgtctgactctttgcgacctgtggactgcagcataccaggcttccctgtccatcaccaactcctggagcttgctcaaattcatgttcatcgagttggtgatgccatccaaccatctcatcctctgttgggaaagttatttacttcctgatcaaaagtgaggcagggagagctcctcttctaccttgaggcattcaccttctctcttccttccagtcatttgtgggacatctccagtcccacgtgccaagcttcaggagaacagccgtgatgtcttagtcatagctttacccctccagttcctggttcagttgagatgaataaatcatgaggtatcacagacctgtgcaacacatccggggtttgaataaaattattctgcagttgaggtcctcagttggggccgattttgccccacccacacccacacttaggagatgtttggcaatgtctggagatgtttttggttgccatgactggtggaggggacggaacctgctggcatctggtgaagcgaggccagggatgctgccaagtgccctgcaatgtacagggccaacctcacaaccaagagtgatccaaccagaacatcaatagtgcccaggctgagaaactctcctctgtagacaaatcaactattgaggtttcctcttgattgtcaagatgagataaatatttgaaagcaaatttctaaacggtggaatctttttttaattgaagctcataatattgtgctagtgtcaagtgtacaacaaagtgatgtgtgtgtgtatatggaatctaaaaaatgatagaaatgaacttatttataaaacagaaggagtcacagatgtagaagacaagcttgctctctctctctctctctctctctctctctctctctctctctatatatatatatatatatatatatatatatatctgtggcttcctgggtggctcagtgggtaaagaatctgcctgcaatgcagcagacacagaagatgcaggtttgatccctgggttggaaagatcccctgagagagggcatgacaacccactccagtattcttgcctagacagaggagtctggcaggctacagtccatgggtcacaaagagtcagacccaactgaagcaactgagcacgcacacacatatggtctatagtatatagattatatatatatatatatatatatatatagtataatgtgtatctgttaatcctatacttttgctttttccctccccccccacctccccctttggtagccataaatttgtttctatgtctgtgagtctgttttggttttgtaagttcatttgtactgtttttagattccacatataattgatatcatactatacttgtctttgtctgagttacttcacttaatacgataaaaatctctaggttcatccgtgatgctgcaaatggcaataaatcattctttcttatggctgagtcatattcctgaagggagggatcgtaaggtactagaccccagaccgtcgtcactgattaacgtacaagcccgcatcaagagttctttgtcagtagggagaccccgttctcttcacaattggcctatagcttctcgaccgcctggcagcctcaaacagccagagggctaaggtttttcttttttctttttaatttttattggcgtatacctgatttacagcgttgtgttagtttcaggtgtgtagtgaagagagtcagttatacatatacatgtatcccttctattttaggttctttttccacataggccattacagagtactgagtagagtgcggtgtgctataccataggtccttattagttatttactttatatatattcggagaaggcaatggcaccccactccagaactcttgcctggaaaatcccatggacggaggagcctggtaggctgcagtccatggggtcactaagagtcggacacgactgagcgacttcactttcccttttcactttcatgcattggagagggaagtggcaacccactccagtgttcttgcctggagaatcccagggactggggagcctggtgggctgctgtctatgggttcgcagagtcggacacgactgaagtgacttagcatttatatatagtggtgtatatatgtcaataccaatctcccaatttatctctccctctcttccttctggtaactataagcttgttttctatatctgtgactctatttctgtcttataaataggttcatttgtaccatttctttagattccacatatgaatgatattatataatattgtctttctctgtcttacttcacgcaatatgacaatctctgtatgtgtggaatattactcagccataaaaaagaatgaaataatgccatttccaagcttggtctttgatcaaggggccagtgtgactgggatctcttcaccttgaggtcaagttctgtagcatcctggtgaggtgagtagtggtgcccaagtccgtggggtggaatagccacggaggtggatggtggtaactcagatccttctcttcatttctcagggaaaagatctcccaactggaaaagtagagcctggaagaagctcccttcatgtagcttttaaggcaaagagggtccaggggaacaagttggagtgactgtcccaagcttgtggggcctccagtctggtaggacagtgacttgggggctggttgcagtagatcagaaggtgatgtggctgcttcgtgctaagcaggacccaaagcccagcgtcaggcagcagagagaatcctcgaggggcctgaggatgcagatcttgtgaggtcttcccaccatccttgcctcttccatccacatcccaccttgtatggtggcttgtttttgcttgtttgtttcatttccaggaaaactgccctttgctgtccctttcccctgatttcacagtgtaggctgattgtcgagccgccacactggcccttccagaacttgcaactctggcctgtgcaatacaaacagaatttctcctggaagcccctttttatctgtggcttctttcccttcccactggccggcctgcagtggtttcgctcataagtgggatgcaggggggttatgtcttccaaggtatgtagcccatatgtccttctcctctaggagaagaaggggcctgggaaggagagggtgcaggagttctcactctgctccactcggaggtggaaatgcaaagggaattcatattctttctagagaagacccccaggaggaatacacgcctgggccctctgcagagttcatgctttgtttagaattccaggaaccactgctggggttagacgaaagtccagaacactggagaatccccaaggacccttcaccctccctgtctcctcccccagactggcccctggctcgcctgctgcaaaaccggctcctgggagacaggttcctgatgaactcattcctagggtgacattcatgacatcatgctaccttctcagggatttacaaggcatctaagaggagaattctagactccgcagtcagagtggagattctgtgttttaggttctgggaaacattccttaacttttcctctcactgagttctcagttcatccaatcagcagcttccccttcatacaactcgagttcccccaccaccagattgagaaccccagtgatcatataagttccagtaagtgaaggtcttgcttttacactttaggaggagaaaggaaagcaaggcttcggctgcacttggcactgagctctggaaggaccccttggtaagacatttgtggctgttatccagggactgtggaccgaggatacacacacacacacacacacacacacacgcacgcacacacacaccccacaaagctggaactacaggccatagagcagggtgggaagaaacgagtcatctgagttaatgatttggaagaattttgtggcatgtcttagccttctctcctcccagggacagctctggacaggccaagcaagggatgctcaggggaaagttctctgtagctacaagaggtttggttttgcagctgttttgtctatgaggtgaagggacagagggaaggcacatggaggtctgggtttgcaaacccttactcagggcatggtcctctggaatgtgccttgacagatggaccggcctgctgtttctcgtttgcctctgcccttccccactcttctctccccactgcgaggctggcctgcatggactgtgtcaccagtctccacccagctggtgttggccagtgggaggcagcactggagttaggtggaaggatggagcatgggcctcggatgtttattctccagggtccctttccactgcagggctccggtttggctctattggtcatcgatgtttctcagtcgtgtctgactctttgcgatcccatggaccatagcccacaaggctcctctgttcatgggattctccaggcaagaatactggagtgggttgccatttcctcttccaggggaccttcctgactcaggattgaacccgcgtgtcttgtgtctcctgcattggcaggtgattctttactgttgtgccacctatggctctgtccatctaacaaatgtcactgccccatcgagagttcctgccactccaccgtctcttcacttggaggtgaccacgccctgcccctccctacaggcactgaaggcaacggctccccactgatgctgcctcgcagggttccttctctacatcagcccacaccttgtaggctgtcctttcagtaaacatccttcagtgacccagcttgagaatgcttgtttcctaccaggattctgatgccgcagatagagaggaaatgagccactggcattcagactgagtccatggagtctggtgtgaaccatctctgattaaaatgatgcagtgttttcacccttctagcttatcacctgatgctgacttggtccgcaaagccccctgtccatcgtaattctttcttctcctccaaactgaccatccatactcatttaagaaacaggcagggtgtatactctctgtcatgggtgaagatagaattccaacttctcacatctcaagcatgtctgctttgagaggcaaaaggttgtagaaaaagggaaaagatttttacagagaggaaaaaacagtccatagaaaattctatttcacttctggggaggatatcttccccacaggtctgtgccctgcagtccttatggtctcagcgtgaagcaggattttggttcctggccagagactgaagtcaggctgaagagatgagtgcgctgaatcctagccgctagaccagtggccagtgacaaggttctggcctgtcagctgcgcagaaatgaatttccacatagagaccagaagtagtaagacaagtgaagtggaggaaaaagggtatgtgtggctagacacacaggcaggctcagagatagagaattgcatacaccctcgtggtagtttagatcatttatatggggcatttcttctgggtttcctttggctaatcatgttctgcctgattctgagtctgtatttgcctatctaagggttcttcccttgtgcacatgcatctcatagccaagatggatcctagcaaagtagcctatgaataagttgacatcacctatgatggggtgctgccccctccctttttgaccttcgaggagcctttctgaacatgtatggtcaggaagatctatttgaccttgagaatgagaaatatgtggtctcttatccgggccaggctcagcttcttctcctcttcatcttggagtatctgtctacagggacaaactctcattgttcagcctgtgtgccagtcgctcagtctgcaaaaaagaaaattcatatgggtgaaattgaacttgacatttcacttgaatggctgaacttgacatttcactcgaatgattttgcttctctttaattcatatctgtgtttgcttgtcagagataagagcacctgaactcaaatgaagcctagggagtactgatttgggacacgaaatgagatatacctaaaaatgaggtggtcctgactcagagagggcacggagaccctgcctttcatgggtgatgactgaatggaagctccaaggggcttgcttttctgtttgggccaaattatgaactaattcttcactaaataacagataaaagatgctaatctgagtctgcttttctaattcaccctgtgacacaggaaaggcttaactggattcatttgtgctgctgctgctgctaagtcgcttccatcgtgtctgactctgtgcaaccccacagaccgcagcccaccaggttcctctgtccctgggattctccaagcaagagtactggagtggggtgccattgccttctctggattcacgtgtgaaatccttggaactccatgaaggtaagtgctcttcggtcatttctacttcttcattggtaactggagatctgggcccagggccaccaagtgaagggccagcaagcagaagggaagaggatgatggaggaggcgagatgcacagttagtcacaagggaaaaattaagcttccattcagcactcaattgctggtctttgcttgtgaagctgtgaaggctgggagctgtgtacagagagtcttcacctctgtaccaagagccaagttcagagggcacagtccccaccctgaggtttgataactcattaggagaactcacagaacacactgaatttttatgctcatggttacagtttattacagtgaaaagatacagattaaaatcaggcaagggaagagaagcatagggtggagaccaagaaatatgcaaaggcagggacttccctggtggtacagtggataagaatctgcctgccaacgtaagggacatggattcagtccctggttcaggatgattccacatgactcagagcagcaaagcccatgagccacaactactgaagcccatgcttcttaagagcctgtgctctgcaacaagagaagccactgcaatgagaagcccacacaccacattgaagagtaacccttgcttgccgcaactagagaaagcctgcgtccagcttcaaagacccagcacagccaaaaataaataaaagtttaaagaaaggggaagagccagatgcaaagttccagctgttatctcccagcagagtcaggccggcaccactttcccagcacagatgtgtgacaatccacagtactgcccaccaagaaagctcaccaagcctcggaatccatagcctttacgggggctccatcatttaaacctggtcggcccccaacaggattgacttttctccagctcctccagaggttagcttataactgtgccatgcaaagcccccaccctaaatcacattgttggtgtgactcaaagcctccaggcaaaccaaggaagctcccatcaagcatgacatccaagggcttagaagtctcccccgagaagctgagggaaaaggccagactgtctctggacaaggctgaattctttacgcacatcctgccactcattccagccgtctctcttcactgggccccatcagtctgtgtgtatgtgtgttcgtccggcggtcgtgtccaactctttgtgaccccatggactgtagcccaccaggctcctctgtccatggaattctccaggctagaatactggaatgggttgccatttcctactccaggggatcttcctgacccaaggatcgaacctgggtctcctgcattgcaggcagtttccttaccatttgagccaccagggaagcccatctatctggacagactcaattcctcagcccatttgtcttttccagatcagatgccacttccaaagcctaatctagataagccctgagtccttggagtccacaagtgatgtgggtgggggtcagcaaaaatagggttagtgtacctctctgaaatcttccacgtaggtgatgtctagatgccttaagtacaagacaaacctgattcactgtttcttttcagataatcatgagattttgtcatctaaaatgcaggtcacgagcagatataacatgactctgtcctattatttaaggatgttcaaagtgagactgagaccataaagaaagctgagcgccaaagactggatgctttgaactgtagggcgctggagaagattcttgagagtcccttgggctgcagggagatccaaccagtccatcctaaaggaagtcaactctgaatgctcattgaacacccagatctgatgctgaagctgaagctccaatactctggccacctgatttgaagagccgactcatttgaaaagactctgatgctgggaaagattgagggcaggaggagaaggggatgacacaggatgagacggttagagagcatcactgactcagtggacatgaagcaaattccaggagatagtggaggagagaggtgtgctgcagtccgcggggtcaccaaaagagtcggacatgactcagcaactaaacaacttctcattattctccaaaattctaagatggttccaagagagagttaaggaaagagacgtgggccagatgctctgagaaaaataaaaatgacaaaaaaacataagatgttcaacttcactaggaactccagaaacagaaattaaaaacaacaatacagtttcctaggagggttttgaacaactcagggaggtggtctccactcatttcaagtgagaaaatcttttcacttataactcccagggtttacctcaaaatggacatgattctgattttttctttaatgataacaaaataataccattataccaacaaaagtggcaggtatcgggggatttaataaaagtgtggtacccagggtttattgaaatcataactcatggcagtcttaagagatgacagtcactttttctttgccattggtcacatggagatttcatttggagaaatcagagccaacaaccagcactgagttttgcaagaggaaattattgcatctccatgtcacccagacccttacctctcttccttccttgggttcccctcccctctgcccacagccagacctgcctgttcacataaccactgaagttgggcaatagaacttaaaagctgtcaaaacctgggtatctatttattagcagaccttccaccttccctgcccagagaaagctcagatttggaggttcaatgaagaacttcatggctgggttgccctctgaaatgaagctgaaaccctagcaccacctatgaacacacataggcaagatgggatgtcctagcatcttcaccttttatctgttgaaggacaggtttttattccatacaccaaaggccatttcctaacctccttcccttctcagtgtccttctattcccccaggaaagaggaaagttcagaactgaacttgaaacttccagcattgcagaaacaccataaggcattttgttcccttgtgaactggtctatccagagcttacctcccaaagtcacagctccgcaaaacgtcaggaatgcagggtgagtgagggccaccatctgccagaaatccaggagatccctgggaaggttctgcaatcattctgaacgagatgaagaggtggaaatgcttgcattgggatccttaagacttctagacccatttcccagaattaatgcaagatttgataacatttccgtggccaacaccattgttgttgttctgtcgctaagtcgtgtccaactctttgcgaccccatggactgcagagcgccaaacttccctgtccttcactgtctcccagagttcatgcaaatttatgtccactgagtcagtgatgtgatccaaccgtctcatcctctgccacccctttctccatttgccttcaatcttccccagcatcagggtcttttccaatgtgttatctcttcacatcagatggccaaagtattggagcttcagcatcagtccttccaataagtattcagggttaatttcctttaggattgattggtttgatctccttactgtccaaagggactttcaagagtcttctccagcaccacagttcaaaagcatcaattcttcagttctcagccttcgttatgctccaactctcacatccatatgtaactaccagaaaaaccatacctttgactgtatgtccaacaccgtcttgaccatcagagaagttcaccaaaacattttaatcaaacagcaagttgatgtgaaacagaaatgctggcaaaacctcctatgtgtagcttcttttataaatgggtctaactcactacaatggtaggttttgccccaagcctttgaaactaacaactgggtttgtggctggcagggaggaccactgacacaggctttgccgtgaattcctgtccgtgtccgccgggagctgtttgaccccacatggatggggacaggctgggcgccaccaccgcgtgcctgttccaggacagatgaggatgtctgagacgctgcctttcatccacagtttccctgccctttgccaatgtgaggtcctctggggaccttcacatccatcacgctgaaaggagcaatacctgggatcttcctgacattcacactcctggctcagactcgctgaggctgccatcggctgccaaaaagagaggtcaggctgggggaaacgcacaggggaccctggaaaaccccaccccctcagccacaatgccaggtgcatttgtggctgccaaggcaaggggcccccatcatccacgcaagcacagaggcaggaggaggctgccttccaggcttgtgtgtcttgcaaatgtatttggtgatcagtcttcatggaggatgttatagacgcctcaaatctatgctgaagccctagtcccagcgtgactgtgtttggagatgggccccctagaaggtaattaaggttaaatgaggtcataagggggcttcccaggtggctcagtggtaaagaatcagcctgccaaacagtagaagcgtgttctatccctgggtcaggaagatccctggagaaggaaatggcaaatcattccagtattcttgcctggagaattccatgaacagaggaggctggtgggctaacaagtctatggggtcgaaaagagtcagatataacttagtggttaaacaacaggagcaaagtgagctttggttatggacaccttgttttcagacttctggcttccagaactgtaggagagtaactttttgctgttctgagccactctgtttgtggtcttttgttgtggaagctacaggaagctaagccaggaggaatgtgtaattacggggcagagatgtaagggccccaagcggttagggctgtttcatccagtgggaacagcaagggcagctgctgaggtcctgagatctaagtgccctggatttaacgtatgggccaaacacagtcgctacgaaagtagctcttcctctgcaatcagtcattgttggcttgaccctcactcagaccaaagcaaagttccagcttctgtcttcccttttgagcctcaagaccacatgttagaggcttcctacagacctactactgcgatatttccaagtctggtggcttattgcaccaataagctgaaaaagagccatcacacaccaagtcacattttcccactcagcagtcccactcctggtcatcaggctcaaggagtcactcaggacacagcagacccagtgacctgctggcctcacagcctggccagtccactcatggcagggaaaccacagcccctcaaaggagtaggaaactgccaaagaaaatagtatttacagagaggttttagtgacagggccaaatgcttttgttatgtatctgtattttgttaagtaaacaaagctggtggccacaaaagattgcatatgcaattaaaaagaaaaataaaatttaaaaactcatatatcttgctatggttatagaagatgttatcagtgggtacatccattaggatggctattatcaaaaagacagaatatagcgagtgttggcgaggatgtggagaaagtagaaccttgtgttctgctgctgggagtataaaatggtgcagccagtgtggcaaacagcatggcagggtgtcaaagaactaaacatagaatgactatgtgatccagcaattccacttctgggtgtacacccaaaagaagtgacagctggatctgaagaggtatttatacactcacgtttataacagcatcattcacaatagccaagaggtaaagcaactcaagtgtgcatcaacaaatgattaaagaaaaagtagtgtagccatacaatggctactacacattccacctcagaaaggaaggaacttctgacacacgtgaaccttgcagccattatgatacgtgaaataagccagtctcagaaggatgaatactgtgtgctcccacttatatgagatccttagcagagctgatgcagagacagaaagtagaatgactgtgagcaaaggcttggaggaaggaagatgggcgttctgatttaatgagtctggtgttttagttttgcaagatgaaagaatttccaaagatggagagcagggatggttgcacaacagcgtgaatgtacgtaacaacactgagtgggacacttgagatgatgcaaaatttatattgtatgtattttacatgactttttaaaaataagggaattctcttggttaggtagtccagtggttaggactcggcacttttactgccttggccaggattcaatccctgatgaaggaactgagatcctgcaagctttgcagtgtggccaaaaagtaaaaataaataaaaagatatcgtcatgggaaaactgagggaaggtacatgagaactctccatactagtttggcaacttgcatgagcctaaaattatttccagagaaaaagtttaaaaataatagtaaaatgagcaaaccctgtgaagggtaaaaatgtgtttataagtgcataggaaagaattacaaatgtttttaggcatgggatctggggaaaacattttttcctttttatctaaccttctagacttgctcaaatgcaactgtattattataattaggggggaaaactcttagttttaaaaagccttctgctacttttccagtcaaatatagaaatgtgagtctcttttgatatttaagggccaaagcagagcctcattgttagatctctagcaacttacttcttaataaacaaatatgtatagatttatgtctataaacacaaataaatttgtattgaaggaattattaacataatcaccatccctctaatcagtggtgagatgaaaaccagagcaatggctgaaaagaaaacaaaggcatcagtcccagcccaggctaaggacaggatggtctgttctgaactgttctatcaatgccatgggcggactgatggccttgtcactgatgatcaggaagcttttctatgaagttcagccacaacaggggagctctggtgcctttcatcagactcttctgtccctttctacccatagcaacccaccccacaaaatgcagagaacgttcttctccagaagaaatgtcattttgagcaaaaattctcatttccaggtgactggctgttgtaggttaaatttgacccctcttcccctaaaagacaatgtgtcacccccaagacttcagaatgtgactttatctggagattatgatagagttcctacagagataattaagttaagatggggtcgttaggatgggccttaatccaaaacaattggtgttcttaaaagagggaatatgggtacaaggacagacacgcacagagggaaggtgacatgaaggtggagggtgacagccgactgcaagccaaggagagcctgaggccgccagaagctgggaaagaggcctggagggggttctccgccagagcctccagagaaagctaaacatgccatgagctcagacttgtggcctccggaactgtaagacagtacatgcctgttgtttaagcctcccagcccaggggatacacaagagcccgtggaaactcacacactggccttcgttgcattttccaagccagctgctttcctgacaagcccacatcaggccaccaaggggtaggctctgcatttggatcagccgttgtgaaactctcctttccagacccaaatctaaaatggctgtttacaagtttgtcatttgtgtccctccagcccttttgccttattattttccagtctggtgaactgctcatgaaaaaactgacttataacactaatacctacccagaaggcccctccccaaattctatcttgctgcagcccagaacaaggaccacagggcccgatgaccttcaggatctgagatgccagccacactgggaggctaaaggcaggacatgcgacctcgtggtaaccttgctaaaccatagtcatacagctttgcctctcttaggtcagtggggtcacaggcacggccctggatcagggctccaggttactgctgtgggagagctggatggtggcttcaaacccacagctgtggcctggcccagaatcaggggaattcacagcccatacaccacaatggggagagtggttggtgggtccaaatcagatcacaagctccaactctgtgtggtttggctacatgcaaaactggcaatactaatacctccaaacctcatacctcccctgtgtagggaggaaggaccttcggggagctgaagggctgcttggacacccccaacctctagctctttgaaagtggtgcctattgcttctctgggctttggggggatgggtacagaagagggaaacaacttgctgagccctttcctctctgaactactaaattcttgggcaatctcaatatatgtcaagtccagccaaaggtctgatcttaaaatcagggtgagatctccattcatttcattattcaacaaatgtttgctgagcgcctattatgctccaggcacagttggtacaggcaatacaaggtgagaaatataagattccgaagctcgaagaacagctggggtgggaagggcaagatgcatgcagaagtagacacctacaagctaacataagttaagtgatgaggatatgcatcaacagctacaggagaatcagagcagggcgttatggttgaatatggatgtgagagttggactgtgaagaaagctgagcactgaagaattgatgcttttgaactgtggtgttggagaagactcttgagagtcccttggactgcaaggagatccaaccagtccattctaaaggagattggtcctgggtgttctttggaaggaatgatgctaaagctgaaactccagtactttggccacctcgtgtgaagagttgactcactggaaaagactctgatgctgggagggattgggggcaggaggaaaaggggacgacagaggatgagatggctggatggcatcactgactcaatggacatgagtctgagtgaattccgggagttggtgatggacggggaggcctggcgtgctgtgattcatcgtgtcgcaaagagttggacacgactgagtgactgaactgaactgaatgcccctcccaaagatatccacatcctaacccccagaacctataaatgttactctgtagggcaaaagaactttacagatgtgtttaaattaaggatgtaaggatgttatcaaggggagagtgtcctggattatatagatgggcccagtctaatcacaaaggttcttccaaatggagtggaagcttagagtgagaaaaaggtggtgtgcgatgaaggaagcagagatgggagtcgtgtactttgaagtggccgcaagccaaggaatccaggcaaccactaaaagctgaaaaggcaggcaaacagcgcctccagaatttcattcagtcccgacaacaccttgattttaggggttgctcctggccacagggcacatggtccttctaaggacagtgtatgagtcaggtttctccacagaagagcatcagtagaatgcttatacctatgtgagctaagttgctttagtcgtgtctgactatttgcaaccctatggactgtagcctgccaggctcctctgtccatgggattctgcaggcaagaatactggagtgggttgccatttcctcctccagggaatattcccaactcaaagatcaaacccatgtctcctatgtctcctacattggcaggcaggttctttacctctagagccacctgggaagcccccatatacctatggggttgcagagagtcagacacgactaagcaactaacacacacacacacacacacacacacacacacctatatagagagagaaattgagggagagagatttatcataaggaattggggactgagaaattccacagtttgccctctgcaagctggaaacccaggaaagctactaatataatttagtctaagtccaaagacaggagaaccatggaccatctggtatataaaccccaattcaaaggccagagaaaatgagatgggatgtcccagctccggcactgaggcagagatgaaaggggagactctcaccttcctctacctgttgttctatttgggattggataatgcccacccattttggggaggaccatctgcttcactgagtccacttccatttcaatgggaatctcatctggaaccaccctcacagacatactccaaataaaattgaatctgggcaccccacggccagacaggttgacaggtaaaattaatcatcatagacaagacaggcatttttaactctttgcaccgtgaatccatccactgtagtggatttctttgtatccaaaggagtggcccatgagacttgcggaagtcagaaactgatttttaaagggatttgccataacctgcctgtgcctggcaccagcaggatttccaacatcacgcaggcaggtctgtgccagggggctgcagaggacgtgcatgtctcttcaagcctgagtaaaagtgagggcagtttttaaaagcagagtctccaacttcctataaaatagaacagtgggcaagttagacgtctgacattaaaaaaaaaaagcgtttggagaaaaagccaagaacagatggcaaagaagaagagttcttgattgtcacgaaaggcttaacaaaggaaggaggttgttcagcaatggagaatggggagttgccttgtcattcaaaagagcaatggaaatgttgaaagatctgcactctggacaattaattgtgagcatgatggctgaagtgttacagtcagatggaagtggacttgaatgccagggaaatttctgtgaaaacttgccaagaattttgattgatgaacttaaagctaaaaagccttggcatttgctcagattgttcaaggggggtttgaagaaatgaaagagcacacatgtttttgagaaaaatagtaactgatcatggaacatggtgtttctattatgatccagaagctaagtgtcagtattcatggtggcaaacttcaacatccctaagacttaggaaaaatgccccgcttcaaaagcaaaagggaagtgttcatttctttctttcacgtcagtgacattgttcaccgtcaatgcagcccacaaaaggtgagagttgatcatattttttaatgcataaacacaaaagtcattgggaaatgtcaaatacttttttaataagactgactgtgatttgcttctcaactatgccattgctttggttcagcccttactttcttctgtctcatagttttggatgaaagaggtgatttaactcacttgattaccagtctgtgtcaccagataaaataccgagtgatgtttggttattaaaatactttttcagcattcattattttattttttggctgtgctgggtctttgtcgctgcacatgggctttctcttgttgtggagcatgggctctaagggctcaggcttcagtagttgcttcgtggcaggtggaatcttcccagaccaggattgaacccctgtcccctgcactggcaggcggattcttaatcactggaccacgaggaaagtcctaaagtattttttaaacctgctcccaaaggaattggacttggcagtgttggtgacattcaaaagaatgtaatgaatcacagttccttggaaacatgaccgattctaggactaaagcaggaaaaacataagatgagtctggagcatcatagaatgccagaaagtaagggagtgctcaaaaaacaaaagggaggaagcgtgtcaatggaacacagagccaacatgaaaaggttctcaatggccaaatctggaacaattagggcaacaaaataaatcatgtatattgaattatcacctaaagtataaacttataagccataagtccatgctgatatcaataagtggttgaataaacaaacaaatgggggaaaagagatatatcttcctcaaaggagaaatactccctcttctgggagagggagcttggttccccctcttcttacttagtcactagcttccaaagactagagtagagaaaggggaaaacagtaactcaacaccaaagaagcctgacaactctactttaagcaaatgatcaaggttcgtttcatcatgctgccacgtggctcccaggtacaccctgatacaatgtgatgagaaaaccaatagaaaaacccatattaggagacattctacaggacacctggccagtactccttgagaccctcaaatgaaagattgaggaactgccactgattagaggagactgggaagacatgataatgaaatgcaatgtgctatcctagactagatcctgggacagaagatgtccagttaatgggaaaactgatgagttttccataacatctggagatgagttaatagtaatacacccatgtcagtttcttaatgtgacaaaaatactctgataatgtaagatgtataacaatgggagaaatggggtgaagattatacaggtaaggagaattggctgtagtgtctttgtgatttttctgtaaatctaaaatttttccaaaataaaaggtcaattcaggacttcttggtggtccagaggttggaatctacctgccaacacaggggacctgagttcaatccctggactgggaagattccacatgcccccggccactaagtctgtgcaccacaactactgcagcctgtggtctagagcccatgctccacaagaaaagccactgcagtgagaagcctgtggtctagagcccatgctccacaacgagaaaagccactgcagcgagaagcctgagcacccagagagtagcccccactcgccacaactagggaaaagcctgcacacagccgcaaagacccagcgcagccaagataacacaaaataaaattcttttttaaaagtcagttaaaaaagaatattgtgaattctaagagagacaccaaaatggaactcccccaaagcattttgaaaaacggcagctatgctagagcaaaagtgtagtttcccaaggggctgcaatcagtgggtttgttttatttcagtgaggagtctcttcctaaagagtagggcagctttccatagctcttcactgcagattgagaatgaggacccaggcccttgattctggtgctttgcacaacagcatagcacggctgtcacaggagagctgacacgtctctagcatttgctttgtatcagacttttttaagggtctttcatatattaactgtttacccctcacttacttcttacctcaaatttctatttatagagatgattctggattttctgcatcttcctctacaccttgctaaacagcatgaatggagagtgggtttcatacctccatgtggagcttgcactagccttcactagcccttcatctttgggacgggggagctaacaagatttgtgaatggactagacatgggatgtgagggggagagtgtggtccaggatgcgaattggacaaggagacatcggtgatgcccttcactgcaagaaggagcccaggagaagctagtctgaagaatgagatcacttgtttcaggagacactgagtgcaatacagtctttttctggggcttgataaatgtgcctgaagttcagagcatactcttattgaagacagagttttaggatgaacaatatgttgatccacggattttatggagaatcaagatttcataaacctctggaaatcagtcttgaatagtcattggaaagactgatgctgaagccgaaactcccaatactttgaccacctgatgtgaagaactgactcattggaaaagaccctgatgctgggaaagattgaaggtaggagaagaaggagatggttggatggcatcactgactcaatggacatgagtttgagtggactccaggagttggtgatggaagcctggtgtgctgcagttcatggggtcacaaagagttggacatgattgagtgactaaactgaactgaactgaactggacacagtattctcacaaatcagcatctgccccaggttgtctctatgtttatgtcagggacttccctggtggttcagcagttaagaacccacccaccaatgcaggggaagatcccacttcccgcggggcaaccaagcctgtgtgccacagctactgaagcccgtgcaccctagagcccccgctctgcaacaggagaagccaccacagtgagacggccccgtactgcaactagagagcagcccccacttgccgcaacgagaggaagccctcacacagcggcaaagacccagagagcacagttaaaaaaaaaaagtttatgtcagaaggtaaaaaaagcatcaacctggccccaggttcttccttccttggggtgaacctgccactcactccagatgtggtttcctctctttccctcccccgcccccaagcgtcccagttttccatcaacacatcacttcctaatatcctcagttctgaacatcttgagacttcacagagttgactcccctctggtgccaaagaccctgtgttgggtccagacttgccaggttattagccctggtgatggcagaagagagcccttaatgagtctgctgctgctgctgctaagtcacttcagtcgtgtccgactctgcgtgaccccatagacggcagcccaccaggctcccctgtccctgggattctccaggcaagcacactggagtgggttgccatttccttctccaatgcatgaaagtgaaaagtgaaagtgaagtcgctcagtcatatctgaccctctgcgaccccatggactgcagcctaccaggctcctccgtccatgggattttccaggcaagagtactggagtggggtgccattgccttctccagtgcatcatatattgtctcccttgaaattcacatccacctggacccctagaaatgtgacctgatttggaaataggcatcttgcagatatgattaaagatgaggtcttgctgagttagacaccaatccaacggcgggtatctttctaagaagtccgtgtaaagacacacagggaagaatggcaagtgaagatggaggctgactttggagtcatgagtctacagtccaaggatgccaaggattgccaagaatcgctggaagctgaaagaggcaagaaagtgtcctccccaagacccttcacggcccggccaacaccttgatttcaaactctcttctcgagcactgtgagagaacacatttctgttgtttttaagccaccaagcttgtggtcattttttacagcagtcccggaaaactagcacagccaggtaaatgggatgagaagacctatgcgatgcaggatagacaaatggaaaaatgggactctgattttcaacctctgcagtaaccagcctgtgaaaccaaaccattccctctgcaacagtcagtccaataggtcaggacttggtcagggactgccagtttccctagttttacctctgcttccaactgcaaacccgctacaaacagccaagcatgctcccccacccaatcacataggatgccctgtctctagttaacctgcctccagcttctccatggcaacagcctcctgtcggggtacacctgaggccttctcttgattccaccatgaagctttcccacttggtggtagagatgattctgactccttggctacagtgagctctgagaaatagcctctgcctgtccttgtggcgggggggcggggggggggtcttcattgcttccacacctggaatctgtaggtgtattagcttgcaaggactcctatagcaacagggaagctaaagcagcagaaatttatttgctcagagctctggaggctggaagcccacgatcaagaggctgggaggctggctcctcccgaggcctctctccgcggcctgcagacggctgccttctccctgcatcctcacacagtccctcctctgtgttcttgtatccctggcgtttctctgcatgatcaaatttcctctccttataaggacactagacacattggataaaggcccaccctaacggcggcctaattttaacttaattatctctctaaagagaccctatttccagatatatttggagcctgagatgctggaaattaggactttaatatatggatggtggaaagacatgattcagcccatagcagaggggaagggaccaggtcaactggggtgagatggagttggacgaatgccaacttgactagacattatatctcccttgtaagaatgcattatctgtttgtagcttttagatgatttgtgtgcaacagagctgaaagactggggtggtgagacatgaaaattagtaagaaaaagcacttcagagtcagcatgagagtacaccgaagagtctgggcctcagtaaactggcatgagggtggcaacggtgagccaggtactgtcccagctaatctcatcagcatctcaccctcatgccaagtctctacccagtcaccaaaggaaaacagtcaagcggacatacgtgcatgggggaaacggggacactggcttcaccacgcacccaaggcccatggttacttgctgccagggtggcacatggaccaatactaggatgagttggcactctggccatcttctgtggagggtgttggtaccccatctgtgagccctatttgtctcccagaccctccacttgaatgtttgtactcaggggcttatactctggatcgggagtattttcctttccctcaagtgcccttcagccatccactaatcaaagtcatctaagtcctctcgacagtcactcttaacacagtaaatcgcctacatatgaaccctcgcgtggtgacctttcaaagatgcaaacatgtgttcacgtgtccgatcacataagttagttcacgtgtgtggtgtgcgttgctgtgtgtgtgcctcctctgcaagcggctgtgcttttgtgtcctttgctcttcagtactgcagagagtctggtagttcaggacctttctttcaagctctgtgccatcaactttttcaggcaggagtgaaatggcagcttgccctccttgttgacaatccttcagctctgccatctcccacctcctctccctcccccagtcagtaactcttcttgcctgtttccactatgccagcccctgtatgccagctgttgtactgtaccactgtacttttcaaagtactgcactataagattaaaactctttcatttttttgtttgttttttttacgtattgtttgtgtgaaaagtagtataaacctattacattccagtactataaccaattgtgttagttgggtacctagactagttttgttggacttacaatcaaattggacttactaacatgctctgggaacggaacttgttcatatgtaggggacctactctatcgttcatgcatcagctcacccacccacccatctatccatccaccatccacccacccatccatccatgcaccatccactcacatccaccaaccaatccatcatccacccatccatccatccaccatccacccacccatccatccatgcaccatccacccatccatccactcacatccaccaaacaatccatcatccacccacccatccatccaccaaccaaccatccatccactcacatccaccagccaatccatcatccacccacccatccatccaccatccccttacccatccatctatcacccccctcatccaccctcccatccattcatccaccacccacccacgcatccatccatccaccatctactcacccatccatccatgtgttgcatgtactcatgaaaaaccaggagtatgcagagaagggtatgtcaaatcatacttgggaaggtggaaagagcagttggacataccctcttctttcaaacactcctcacagatcaatttccttctttctattatggtcgtcaccaggtccaccctctctgtggcccaaaatttgcaaaggggaaaaaatggacttcagacgtcatgacagccctaagaatccccaggcccccattaattctggtctctttacccagcgtggtgagaagagaactgaccatggaggcagatgctgccaatgacaagtttgtgttcttcatgcctcatttctctggtctggactcaaatgcatcatctgtaaatgaggaaagttgaccctgactctgcctcttaaattatcccctgaaatgtccagagcaaagaggacagtcagtggtggattcacaatattcacactaattttgcatctgaatacatgacacatgttagttttaagtcaaaaggaaaatttatttttgattatcagtggactataaatactctgctccaagaagctgcttcatgtttatcctgagaacccctgtttatcagtgctctttttggactgccccaaactcctggggggactaagcccaggaaccaggtgaccccaagatccttgtgattttgtgccttgggctccagtgctctgaaagtgagtatggctcacgtcattgaagtggccatgggtgggaaggactctgaatgggctcttcagggctctctgactcagagggcacgattcatctttcagtggaggggacactggtccagccactggtgacaccacgtcattcaggtgtgagtaatggccatgatttgtccacgaggcactacgcagctccacgtcggctccagatttagacttgttcccttaaaagttgactaagctctctctttttatgagcaagcaagagcccattttagagaggccattcacaaagagaatggaaaacagcttgaatggaatgtgatttgagcactagggccatgctctgctctgtaggacgaatccaagagtgggactaagttgcagcaacagactggtgaccaacatgttcccccgagacatttttatgccctatggatggcaaccagagctggaaatctaccaaaagcaatataggaagaagctcttgctttctctttttttagtatgtatttttattactcaactactttgttagtcatggtatttttttttaataccacacaatgtgcctggtattagttccctgaccagggatcaaacctatgccccttgctttggaagcagagagtcttaaccactggaccgccagggaattcccaggagctctcaggtgacgggacacatctgaacatctatgtgctggtcatgtgagcagggcaagctacctggggtggtgtgcatgctcagtctgattcttttcaaccccatggactgtggcccatgacgctcctctgttcttgggattttcccagcgagaatactggagtgggttgccatttccttctccaaagctacctacacacacctctaaaattaagacaacttgaccattccacagggtccgtgtgaggcttaaagacagaggcctgaggatcaaagtctgtgtggcctatgttttcccaccagaaaaaaagcggtttctatatttttaaaaattgtattaatgtttggctgtgctgggtgttggctgctgcgtggcttttcgctagtcgtagcaagcaagggttactctctagttgcggggtgcgggcttctcattggggcggtttcccttgttgcaggctctaggacacgggcttcagtagttgcagcacgggggctcagaagttgcggctcgcagactctggagcacaggcccagtagttgtggctcacgggcttagttgctctgaggcatgtgggatcttcccagatcagggatccagtccatgtctcctggactggcaggtggattctctaccactgagccaccagcggagccccggtttccacattattcaagggttgttaagaaggaaaacacaaagaagagtatgcaacgactgcatgatcgtctgctaactgtttgctacctgaccctttacagaaaaagtgtgtgggtctctggattgaaggaagaaatacccttgaaaataactggcctagggcctagcacacaggggatgcttggaaaaggtagaatttcactaccaaaaaaaggacaactttctgggattaatgtagttgcaagaaaagggtaaatgagattcaacatatgggacaaaatctgtaggatttgtagaatatataaatatttctatttggccttccccttgtgttagtctgctggggctgccgtaaccaaataccacagactgtgcagcttaaacaacagacatttattttctcacagctccagaggccagaggtccaaggcccaggtgtctgcaggttgggtttctcccgaggccactttctgtggccggcagatggctgccttctcactgggtcttcacatgctctttcccctggctggtgtccctctgtgtgtgtccaaattttctcttcttacaaggacaccagtcagactgaattatggcccaccccaatggagaaggaaatggcaacccactccagtactcttgtctggagaattccatgaatggaggagcctggtaggctacagtctatggggtcgcatagagtcagacatgactaagtgaattcactttccaatggtggccttatttaaactcaactctttatttttttatgtttatttatttatgtattttgttggctgtgcctcatggcatgtgagatcttaattcactgactgtgccccctgaagtggaagcatggagttttaaccactagaccaccagggaagtccctaactcacctctttaaaggccctatatccaaccacagccacattctgaggcatctggggttaggtcttcagtatataaattttggagggtatgtacaattcagcctataactgtcctcttaaattaagggaagtattaataattaacaatgctcatccctttatttaggacaaatccttatccttgctggagaagactcttgagagtcccttggatttcaagatcagtcaaccttaaagaaaatcaatcctgaatattcactggaaggactgatgttgaagctgaagctccagtatttcagccccctgctgtgaaaagccaactcaatggaaaagactctgatgctgggaaagattgaaggcaaaaggagaatggaagggcagcagaggatgagatggtttgatggcatcaccgactcaatggacatgaatttgagcaaactctgggagacagtggaggacagagaagcctgcagcactgcagtccatggggttacaaagagctgggcgtgacagagcaactaaacaatgaacaatccttgtacatgaagaggatccataaccatgtaacaatgggaaagtccagcccaatgttaagggactgttaagagaggcatctgtactttccctggggcagaaacattaagtgcacccaaaatatgcatattgctgtgaaagtgctatactcaatatgccagcaaatttggaaaactccgcaggggccacaggactggaaaaggtcagttttcattccaataccgaagaagggcaatgccgaagaaaagttcaaactactgcacaattgcactcatttcacatgctggcaaagtaatgctcaaaattaccatatactccctcacatttctcagcatcttgctcacaggaaggcccagaggactagttctggcctttatggaactcttaagggccagtggaagctctccagcttgcccttctttggctattttgttgttcagtcgtgtctgactcttcatgacctcatggactgcagcatgcctggcttccctgtttcgggaagcttcttggctatggcagccagagaagcttcattctgaatggacagaaccgcaggctggaagcaacctggatccctgagttaccacatggaagagagctgctctggcatcagccaaactgcataaacgtgtaagaaataaagctttattgtgcaaatcacagtgatctggggctcagtctatcacaccaaaacctgatctatcggacacactggttgtcagaagagagctgaatgctggggaagggtcacaaaagacatgttcatctcagacctgccgcgaattcactacctaatcttgcacgggaagccttattcctaacaaatgcttgcactctgcccttggttagctggctatggtaacaaagcctaaaaagaatacagtttgttattcctgaggctttatatatacaatatcagccaaagacttttctttcacaatggctattaggccaggacttccctcgaggtccagtggtcaagaatctgcgatccgatgcaggggacctgggcttgatctctggttggggaaccaagatcgcacactgctgtttagtcactcagttgtgtccattgcttttgtgaccccatggacagtagcctgccaggctcctccatccacaggatattccaggcaacaataccagagtaggtggccatttcctttctccagggcatctttctgactcaggagtcaaactgcatctcctacactgcaggtggattccttacccctgagccaccagggaagtccgcatgccatgggacagctaagcccatgtgtcccaactactgagcccctgtgctacaattagagagcccacagcgaagatcccacatgcaacaactaagacccaaagcagccaaaaataaatattagggaaaaaatagctttgggccatctcctgagcaaggaatacgttgtgtaaccagctcaggcccttaaatcagagccatttatttatttatttcatctgtaaataatgcatctccctggcattgtccactctgtgctgtggtcattggttagtgcctgagcttccagtacctcagtctgttccacatactcagagctgccgcccccaaaggcctccttatgtgcaccccagttcagttcagttcagtcactcagttgtgtccaactctgcgaccccatgaattgcagcacgccaggccttcctgtccctcaccaactcccagagttcactgagactcacgtccatcgagtcagtgatgccatccagccatctcatcctctgtcatccccttctcctcctgcccccaatccctcccagcatcagtcttttccaatgagtcaactcttcgcatgaggtggccaaagtacgggagcttcagctttaacatcattccttccaaagaaatcccagggctgatctccttcagaatgggctggttggatctccttgcagtccaagggacactcaagagtcttctccaacaccacagttcaaaagcatcagttctttggtgctcagccttcttcacagtccaactctcatatccatacatgaccacaggaaaaaccatagccttgactagacggaccttagttggcaaagtaatctctctgcttttgaatatgctatctaggttggtcataacttttcttccaagctcaaaggctgatatacatgtggaaggaaaccgcaaaggctacaatgttccccactctttaccgccctgagaccttggtgccacagacatcagctctgagagatagtgtcctgaaaagaggtctgcagaaaagaagtacaaatatagacccacatttgtctttggaaccagatgtctgaagcgctcccttgacataaaaaaaaaaaaaaaaaaaaaaactgccacaaataatacactcatttactactcaggaaatatgctcctttcactgaaaagtgatgacatgaaattgaaccagctcccagtcctgctctgaattattctaactgtgcctgtagcacagagagggtcttgtagagaaaacaaatgcaataatcgagaggcttccagacgcaccccccctaaaaatatcagtcttgcattctttctgaattggtctcattttatgacacggttatatagcaagtattttattgacttaatctagtaaaacccagcaaccttttaacagctaacagataaggaggcgatccagggtggctgcttacttgggagatctgttgagaaagaaagagtctttgtcccggtttaagagttgatggtagatggcggaaaggccgtgatgctcagaatctcaacaagccatatgattttgagaatgacttaacactgtgacgacctggtccacacaggcacctcaaagatgtgtgctataaggacagctcaatctgcagttgactttcccctctgcccgtggtggccaagccctctgatgtctctgtgttcgtggaggtgggggccatgtcccccaaaacccctctgggaccagctcactcaggaccctggagtccctaaaccatttgggctcccagttttctcttcttcaaaaaacttggggttgcaccccatggaactctgctcagtgttatgtggcagcctggatgggaggggagttggggagagaatggatacatgtatatgtatagctgagtcccttttctaatgacctgaaactatcacagcactgtcagtcagctatatcccaatacaaaataaaaagctcaaaagcaaaaagaatttaaaaaaaaaagctggcttgcaccagataatctcaagtccctttgtgttctaaaatgctctgattcctgaaacaaaggatttatcacacagtcgtgtccgatgctctgcaaccccatggactggagccctccaggctcctctgtccatgggattctccagacaagaatactggagtgggttgctatcatcaatactagctacagcttctggttcccccacccccaccccatcaaacttcagagagcttcatgaagcggaaaccacgggcctctcgatttctaccatgctatactgcacagggcggccacagagctcaggggacacagggcttaagcaagtccataaatatgaaaaacgttttgtgaacacttataaaggaagtcagaactgggccaatccaaacaccccatctggactcccccttcattctactcatcacttcaattccccctcaccctcaccaagtcctgaaacaaggaccagatctagaggggacgttcactgatgtcattcttcacgcgtcattttcagagccttaagctagtctgggtctagcttaagcagacgttgaaatgggcttaagcatgtgaagattttattagggcagatgcctgtgagaaaatggggagggaggccagggaaattcaggaattccagggcttctttggtggttcggacagtaaagaatctgcctgcaatgcaggagacccaggttcaatccctgggtcaggacgatcccctggagaagaaaatggcaaccctctccagtattcttgcctggagaatcccatacacagaggggcctggtgggctacaatctatggggtcacaaagagttggacacgactgagtgactaacacttctacactctcacaaggaggaacctgaacatttcccctgcaaaaagaaaaaaatgttgattcaccttgaacggccatttgcagtacatcaggcagatagaagtcttcagacacccctgtagcaatgaggcaaagccaaaaatgcctgaatacccacacctcgatcccctcttgtattctgtctattgctgggccaagaaccttgcttagaagctgacaccactcttttgcaacatactcttagttttcagacgtatcagtcaataaacgaagcagtcaaagtgagggaaaagtgtatttcacagtcgttataaaagtacatatatttcataaaggtgacgtaaatacagtccttacttatgaccaaatcgtacaaccaaagccaacttgacttccggatatcacacgctgatagtcgtcactttcggcagtaactacacacaggctgactgagctcacgggtcagactaacaagagacagccatgggtccaagagacgaaacacgctttgtacttaccaaagggatactcaaggtctccatataaatataataaaataataaagaattcaacatttctcctctcactcgactccatagatttgtcgggcgctcacacacacaaaatacgggttctccccttcctcactgccccctcacctctcactgggcttggaataaacctgagttcacagttcaagttgccagtggtgacacagacagtcggctgttctggaagcgtgccaggatcgggggacacgtcccagcaggtgaacacagcgacacagaaatgctcatggtcttgaggcaagtaaagcatgagagagacagaaagagcttagaccaagttcgtgggcacgcagcctgcaagcctgcggagccacacttgcagctggaaaccatcttcaaagagggttcttcactgatcaaaaacccaacactccatgtcaaatggagagaggaacttctcagctgcttcttttattctctctgcttaaaaaaaaaaaaaaaaaaaaaagctctacttttcagtggaaagttccagaacctggtttggagccatccaaaggagtgccacccacggtggggagtctgacctcctcccaacaagccccagggctggggcgatccccaacaaggcgagggggagtagcagcccaaggtctcgtcaagatcagccaggaatgggcacagccaggtgtccaccctctctttgctcagtcagggacatctgggccagaaggaggtcaccagtgtggaatgagaagaaaggaagacccacccccagcactctctggcacaggctggctgccgggggaagcgaaggcgggctttgcaggctcccagggtcatggccttctttcagatcagtgggctgggaggactagccccggggtggccccagcagcagtttctggtcacgcccgcagcagccagcagctgaagactccaagccacagtggaacctggctccgagctgacctgcatccaacctgtgccgattctacttctgccaattctgttcatggccgagtggtccccaccaagggccagggccccagccccagtggagacagctcccggcaggctcctaactagacaaagacaacactgggatccacaaaacacatacacagggacggcatggacacagatccagaggtgcatctttggttccatccttggcaaaaggtgtgaaaaccgaccacggattcaaagccttgtttgaggaaccctgctttcctcaaagaagatacagtactgtattttgaacgtgagtccctgcacaagagtctctcactgctcacggcaaactggctgagctctaaaccacacttgtcgccttggcagcttgaaaactgcattgcacagagctagaggtgccttccgggcgcgtccatattcaaccttacctgtcttctttctaaataaccgactgtaactatgctctgcaccttccagaaggatccgggctctggtgatccaatgggaaggacaggcagccggcgaggatcacgtccccccctgcaggccaccaggggccagtgccactgaaaacgtcacctgggcaagccttgatgccctccatgctcgtcctctcgtgagaacaggagtttggtgaaatcacttcccatctcgccacccaggtttctaaaaatcatgttgactcgatttaatgacatcacataaagaacaataacctttggagaagatactaataattcaactgttagcaagtttcaaccaagtgaaaaaaaattccatcaagaccctgcttggcaaatgagtgtcccacattggtcttttccattcactggggaccccgctgtggggatcagtcttggatccaaccagagagggtggtgctggtttctaagcttcctgcccaccttccccaggggctcctgaagctgggttctctgggtgaccagctcttgccaccctgcagggagttctctcgattaaaggaggggaaactgtggcctgggtgaaccaccttgtgcttccctgccacgtgactgctgaaatgagaccaacccactgagaggcgcacacagagcacagcgcggagagacggctcagaagggtgtatcgtctgagaaggccgaggccagtgcagggttctccctgccagcccggcggagggaggtgggtggagggccagtgaacaggtgggaggaaggaggccatggctgatggagttggccacacagacagccaaccttcctgggagtctcagcatctccagtggggaccctacatgagaatggggagtacaggctctgggtctgtggtttcagctgcagggacagcgactgtcaggaggaggtgaggctgtgaagggtactccaggagaggtgttagaatctttgcaccctgattgatacggggagctgctccactgctttccttagaaacgcccagatgcccttctctggcccaggttagcactggcctttaaccccatcagccaagtcgaaggagaggcttgtgggggccaggggctgcagtgggggcatgctggcctccaggggcctgtctgcagaaggctgcaggctctgatgccgcttcctcagcatctgtccgatgcccatcatggggaacctgcctcggctcttgacacagttggggcttcccaggggttgcgcagggccattaccgggccccggggctggggagcacgtgccctcctctttgggggggctgttcttctcttcgtgagcaaaggagaccagagtggggtgcaaaggagtttggaggggcaacgggcttccaggcagcaggacaggcgagagtgtccgctcacagcgagccagacccccaggggagttcagaatcctatagtgatgggacggggagagtagttctgtctggtcgtctcgatccacggactcgaaggagcgcaccatatccagcatcagggggtcttccttgatggggaggctggtgctcccaggcccctgctgagggggctccggtttcttcacaatcctgggggttctggggggtggcaccgggatgaactccatggaggaggaggccacacaattggagtccgaggttttgcgaaaaatattgcggcagccgaaggaatctgcacaccaagaaagaaaaggaaatgtgaagacaccacagtcagtgcccacggccctgttcccacgtactcggaccccagttgcactgagacggggcgggaggtgcccaggggaggtcagacgggacgaggggcacatggcttcccactctccctgcggggaaccagacggacttcctggagtagagcggacagaaggccggggacaggaggcctcctgggttctgacttgcctcatggcaccagcttaacttctgctctcctttctgttgcttaaaattctggaccccgcccaagagcctctgaatgaaaaggtctgtggctcaacagaatgaccacaaaactgctggaagcacatggatcccaactcactgaggacttgcaagtttagtcctcagataatcaaaaccggaaggaaagtttcttcgtaacttaaaaaaaaatatcatggtaaaaattacataacataaattttaaactgcttatttatttattacttaacctcttttaagtgtacagggcagttaagtacattcacatgcttgtgaaatagaactcttcacttgcagatctgctagtggttgcctggggcaactggtctatacatctgactactctagctccctcatgtaggtggaatctacagcatttgtcctttcgtaactggcttgtttcactgagtacagtgttctccaggttcccctgtgctggagcatgtgtcagaatttccttcctttttaaaatttttatttattcattactttcggctgtgccgagccttcattgctgggcggggggtactccctagctgtggtatgcaggcttctcattttggcagcctcccttgctgcagagcatgggctccagtgtgtgtgggcttcagcacttgcagcacgtgggcttcagcagtgcagctcaagggctctagcgcacaggttcaacagttgtggcgcacgggctaacttgctcctcggcatgtgggatcttcccagatcagggatcaaacctgtggctcccgcactggcaggcggattctctaccactgagccaccagggaagccccagaatttcctcccttttaaagactctctcatgacttctggtctccctggagcctcaccaatcctgaacaggggtgaaacactcttcatctatatatctcaggcaaccagccaactcccgtggcttccatctcaagctggcacaggctagaatccaggtttgcaggctttggcagagaagaaagggaaaacccccggtgtttggcgctgagggaagtgaagccaggttcccatggatcaggccctgtcttggttggttctcctaccatcacacctgacagccctgttggagcctggaggcaggaacgagctgttgccaccgggagctatttcggcgacagccaagggcactgggaatcctctttcccttacataaatatatacacagatccccaaataaatctcctcctggggccagcacagatgcctgagattcacgggcagagagacgggaaatttcattgatggctaacgtctccagcgttccagctggcatgcaagccccctgcctctccctcagatggctgtgtgccccaatcttgtagcccagcttctccctccacccacttctgcttcctctgcttgcctagaggtgtaaatactggcaggatacctcccacaggcaccctatttattcccaccccagagtcagccctggggcagagacccagaccctgcctggtccctagcaagaagggcagtcaccctgccagagcgataggcatgttggctggctcctcctcaccccattctttccgggagggagtcagctaccctggttagcagagaaagctctagagctagcctgctgggctggaaatctggactctatcacttaccagctccctgactttggagaactctctgctatttcctcatctctagaaatgggggtgagaatgacctcatgggctgaggtaagagctgaagcagtgccggccacgccatgagtggtcagtgtgaacagttaacacaggatcctcagcgcttctcggcacagattcccaaatcccaggacaaaggcaaaatgcaaaggaacagatgacagctggcccaggaaagtaccaagaaacagactcttatgtagcctctggggctacctacgtgagtgaagttgctcagtcacgtctgactctttgcgaccccatggactgtagctcccccaagctcctccattcatggagttttccaggcaagaatactatagtgggttgccatttccttctccaagggatcttcccaacctaaggatcaaacctgggtctcctgcattgtaggaagacgctttaccctcgaagccaccagggaggcccgctacaaagttaaccccaaatatgcagcttctacctagaccttccttcggggaacccacaggatgccactgtgagggcccggattcactgctggttccaaagccaggaaggaaggtctcccgaggagggacaagcacagtctctccagtggggcccctgccttcctgacggctgcagaatgaaatggaaccaagtagatttgctcttccctgggtgacagctggtccctcctagagtcaggaagacccgtgctactgttttgaacgtccccagtactttgccaacaaaggtccgtctagtcaaagctatggtttttccagtagtcatgtatggatgtgtgagttggactataaagaaagctgagcaccgaagaattgatgcttttgaactgtgatgctggagaagactcttgagagtcccttggactacagggagatcaaatcagtcaatcctaaagnnnnnnnnnnnnnnnnnnnnnnnnnnnnnnnnnnnnnnnnnnnnnnnnnnagggaattatggtgtgtggcagtccatggggtaggaaagcaaagagtcagagatgatattatgactgaacaacaacagtgtactttcgtgctggttaacatcagacagccagagccctcctggaaccttagtttcttcacattaaaaacaaagggatttaaggctggaggccaccacctctcccatgcccgctctgtaaggggaacggtcgtttagtccccagttggacacgcagtggtggctacgggtgtccgtccagggtgtcagggtgtgttaagtctcctttccacatccctggaggcttgctccagaggagggagacccatatccatcagttaccgcatgtgctggacgatgaatgaggaggagaagcccacacgtgtttctcattgaagtgaaaagtgaaagtgtaaatcactcagttgcgtccaactctttgtgaccccgtggactgtaccccaccaggctcttctgtccatggaatttttaggcaagaatactggagtgggtcctcctccaggggatcttcctgatgtagggatctttaccatctgaaccatcaagggagcccttatctcactggatccacccaatagctctgacaggtaggtttcttttcacaaggaagggaatcagtaaagatcctcagaggatgaggaacgtggggcatcagcagcctcagagctgggtttgagcacctccacccagagcccagactctgtggaccacatgtcactgcctctcagggtatacttttcagggaaggctcccacgagagcatgccccatccctgctcctgaacctcaatctctgccccttaaaactgaacactgatgcctggctccatgatactatgcaccccaacctctgctacctcaataaaataccaagtaccccagtttctactcccacaatgccatgcaccctggtatctgctctcccacaaaaccatgcaccccagtctctgctcccatagtaccacccaccttgacatctgcttctgcaaaatcatccctcccaatctctgctcctgcaccccatctctattcctgtaccccatctctgctcctgctctccagtctctactcctgcactccatctctactcctgcaccccaatctctgttcctgcatcccatctctattcctgtaccccatctctgctcctgctctccaatctctactcctgcactccatctctactcctgcaccccaatctctgttcctgcatcccatctatattcctgtaccccatctctgctcctgcacccgagtctctactcttgtaatactttacaccctgattcctgcacccacaagcctatgaaccccagtctcctgcaatactttacaccctgatttctgcacccaccccgtctctggtttctcaaatcccacccacacaggtggaccacaccaagcagtcaggacaaggtcttgttctcacgttgcctctcaagcattaattccgctttcccatgggcacaggagtagtgtctgtcccaggggcgcacacagaaaccagcatgggatacacaacagccacgcaattgaacacgagaggcctagacagtcccccacgctgacccacctttgtcggggaagccaggcttggaggccttgcggtccttgagcagggccctggtgctctgaatctgcgtgatgagcgaggccgacggctgtttgtgcgacggcaggttcttgtccagcttcttggaaaatggtcgatgaagaaaatcccctcttttttcttgttctttgggctttttatccttccaatcagaagcaaacataggtactcagatgcacacaagaatgcacaacaggatccctttttgaatagttatcaaagtagagttaagaaacctcagttttctaaaatgccaggctctcagctgcatcaagggaagcgcccagacccagaggacactccagggaagccacggccctctccctgggccgcagtgtgcttcggtggtccctggctccctgcactgtgctgttctggcatgttccatcaagggcaaggatatccctgggtggtccattttcttagaacaagctgaacaaaccgaggtaaagcctatgaggactcctggtaaccttccgtcttagctacagcagagtcccaagattctccccaagtagtggatttgcagaggcaagaagcgctccatcataacctcagtgttcagtgaagccgaggaggtggacgcccgacccatggagccctgagcctgcctgggttaatttctgacccctgtcttgccctgctcacgtgggctcctgctgtttagtcactaagtcatgtctctgctgtgtgctcactcagttgtgtctgactctttgcgaccctatggattgtagtccgacaggctcctcggtccgtggaattttccaggcaggaatactgaagtgggttgccatttcctcttccaggggatcttcctgacccagggactgagcccgtgtctcctgcactgcaggcagattctttaccactgagccacaagggaagctcatgtgggctcttaattgtgaacttcaattggcagaattcagccatttgtgccgtcaagtcttgccctgattgaactcaattataatccctctgatgggagtgaatttgactgttttatacatcttcaaccccacagcctctggcatgaagccaggcatggagagaaagcttatcaaatagttattgaaatatttaaaaaaacaaaaacaaaagagccagtggaaacggaactgaattaaaatgaattgggttcaagcttctgggaagggtgatgccacaaggaagaggcttttttctggccctaaagactgtgtttgatgtttactgtcaaacagaggcaaccgaatccctgacctcaccaggagtgcgggtgtgggggggaagagaccaattttcacattttttgccttaaaaccttaagaacatttgcaattcaagaaagctcatctatttttcatggatgctgttgaaaagcttctcaaggaaacatccccttgcacttgggtagccctttctaacaaggattttcaaagcctttctggattggggttcattgtgtccaggttttgagtgggaaagatggcagaagagaaattggatgtgggggcacacaccccagccttgagtgccacctcagggcagcagctgctgggagcccagcccttggctgaggtggctcgctccccccatgggcgggtggtcaggacaaaggcagaggtgaagctcctgcaaacaccttcaccagcgtcttatcagccaccaccagctttactgaagatgcttggaacgtcagacgctacgctaagagcatgacccctgatgaggcaaatcctgttatcccctcttccagaggtgcctgcagtagctaaatatacccagacaattcaaaaagatgcatgcaccactgtgttcacagcagtactattcacaacagcctaggcctggaaacaccctaaacgtctgtcgacagacgagtgcatacagaagatgtggctacatacacacgagggacactacacagctgtgaaaagagaaggccactggcagcaacacggatgcaactagagactctcatcctaagtgaagcaagccagaaagagaaagacaagtaccacaggatgtcacttatatgtggaacccaaaacagggcacaagcgaacctatgtacaaaacagaaagagattcacagagaacacacttgtggttaccaaggggaagggggaggcggagggatggagtgggacttgggggttggaagatgcaaactgttacatgcaggatggatgaacaagggcctaccgttgaacacagggaactatattcaatatcctgtgataaaccgtagtagaaaagaacagtcaaaaatagggatgtatacacatgtatcggagaaggcaatggcaccccactccagtactcttgcctggaaaaccccatggatggaggagcctggtgggctgcagtccatggggtcgctaagagtcgggcacaactgagcgacttcactttcacttttcactttcatgcactggagaaggaaatggcaacccactccagtattcttgcctggagaatcccagggacgggggagcctggtgggctgccgtctatggggtccacagagtcggacacgactgaagcggcctagcagcagcacacatgtataacagagtcacttggctgtacagcagacatgggcacaacactgtaaatcaactatacttcatttttttcttttaaaagaattcacccaggagcctgacagcaactcagatttttgcagccctccctgaaagtcgatgtgttcttaacccttgactccacactgccctctggaagatggagcagggccaggcttgttctggtggcagagagaaaggctaggcacagtgactggctggggcagggaccacactgtagtccagggcatccaggatgctacagaggagaccatgagcaggatgctatgaagggcggagcggagggcggggcatccgctcctggtcaaggccaagagcaattctccactgcctccctctccctctttctatcaaacaccaacaggccctctgctctacagcaaagaagaatgaactttcaccatccccagcctctccccaagcaataaacggcctgtcccaaaaagtctggcagaattccaccccaaagtctggctccattctatctgtttttacgagcaaactcatcaattctacctggtaacaccttaaacaggaaaatagaaatcaaatgcacttttgtgatacattgtaaaacaatatttggaagaaaaaataaaactggagttacctcaccctccactgctcacaaccccaacattgcccccctttttttaggacagtgagtacatcttcctttgggctaccctgcatttcctgctctcagagggctcctgccggcagcctcctgggttcatctcagctcctttctaactctctgtggcttctcaaagataaaaggatcaagatgcaaactttcaggggggccagtatcaccacccagacagagctcatgaaccaaaggatgtccaagatgtgagagttctctgtaggacgagatcaaggttggctctagaaatctctccttcaacccacaaagggatctttggcaatgagcagagctgactcactggacaagcccctgatgctgggaaagatggagggcaggagaagcgggcaacagaggatgagatggttggatggcaccatcaactcaatggacatgagtctgagcaaactctgggagacagtgaacaaggaactgtgctgcagttcatggggtcacaaagaatcagacacgactgagctcctgaacaacaacaacgagaaagcccacgatggggacagaagaaaggggacgtggatttaggactagagtctggggaaccttactcacatcgccctgtcgatcctgcaccttggtgttgttcaaagtgctgcactcaatatgccatcaaatttggaaaactcaaaagtggccacaggactggaaaaggtcagttttcattccaatcccaaacaatggcaatgccaaagaatgctcaaactaccgcgtaattgcactcatctctctctctattaaagtaattctcaaaatcctccaagccaggcttcaacagtccgtgaaccatgannnnnnnnnnnnnnnnnnnnnnnnnnnnnnnnnnnnnnnnnnnnnnnnnntgtcctggagtttgctcaaactcatgtccattgagtcagtgatgccatcgaaccatctcatcccctgtagtccccttctcctcctgccctcaatctttcgcagcgtggtacttcctccaaactacccccatcctctccccaacccccagagcattcttctcagcctgaaagaacagatgacttcatagtgatgggtttctagggagatgccaagagtttactgcccatctgctccttgggggtgggggacaatgccctggatctgtcccggtgatccctcaggaaactgacttgtttacaagcagccatcttcatgtcttccaagcagagattcataaatgcaaccgattttccaattctaccattttcatttgcatggcctattttctccaaaagagatttcccagggagaaggatgctaaattgccttatgtaacagaaacagatcttcagaaggactaattatgttcccccttcgacatgcctgcacccactcgcgcacaccccacctagcaacgctggccgcctgcaggcctcttcagtctccctctgattctcatgggtgggcagtgtgcccctcatccgcatgtgcctaagggcgggtagtggagctgaagcttcaggggtcttctctgccccctcatgctcagtccataccctccaaggcggatccaggaggaagccagaggccccagctggaagcaaaccccatacaaaacagcctcttctctttaaaccattttccaaccaccacacatgtgcatggatgtttttcaaaaaaactggatgccttgaatatgcagaccctgacttccctggtggttcagtggtaaagaatccacctgccaatgcaggagatgtaggagatgtgggttcgatccctgggttaggaagatcctaacctggatgagatggttggatggcatcactgacttaatggacgtgggtttgggtaaactccaggaattggtgatggacagggaggcctggtgtgctgcagtctatggggtcgcaaagagttggacacgactgagcgactgaactgaactgaacctggaggaggacgtggcaacccactccagtattcttgcctggagaatccccacagacaaaggagcctggcaggctagagtccacggggttgcaaagagtcagacacgacgtagcaactgagcacaggcccaagcccgttacataagggaagccacagaagcctgattctgccataggaaataaacaaatgagtataaaaagggcttggtccgtaaattaggccactgaaccaggaagccgtggactgttctaaaccccacttctttacaggtagaaacacaaatgcacagccaagtttgttgttatagcaagatgaattttaaaaaagtcaactacacaggtggctctagtggtaaagaacatgcctgccaatgcaggagacatacatgggcttgatccctgggttgagaagattccctggaagagggcatggcaaccactccagtacctggagaatcccatggacagagaagcctgatgggctacagttcatagggtcaaagagtcagacatgactgagtgacttagcacacacacagagaaagctgatctgatctgaggggattctgacaaatctacttataataggattctgcatgtctgaattcaggacaggatgagaggtgtgcagactccagaactctgggcagggattccctaatcttcagggtcatatgcaatggtgactttcatgtgtcaagttggctaggccagggcacccagtgtctggtcaaacaccagtctacagtttgtggtgaaggtttgtgttagataagaatgacatttaaatcgctaggcttttgagtaaagcagcttgtcttccacaatctgggtgggtcttgggcaatcagttgaagggcttaagagaagatgtttggcggaaacctacacaatagtgtaaagcaaatatccttcgattaaaaataaatttgatttaaaaatgagagagagaagactgaagtgtcctggtttccttcttttgaaggaattctgcctccagaagacttgggactggagctgaaacataaactcttccctgggtgtccatgcatcacacacacacacacacacacacacacgcactattgattccgcttttctggaggactctgtctaatccatcagaacctcccccaatttcttacctgcacagcatgaaattcaaggtctcttgtccaggtgtccagggaggcctgcaaaaaacccagcattttcaacaattcaagaagctacacttgtttattccctaaactcaccccttcccacctgcagctctggttgagggttacccatttcagtgtttgcagacaagaaaccaaactgccccagaagcaggcggcagatgtcctaattcctgccctggagagatcttctaggtaaggtttatactgaagtctaggacacatgacggaggggtgctctgatgatgagtaaggcatcgactcggttttctcagtcaacaaaagcacgcatgaaaacggcgcccagatcaagaaacaaaacccagccaacacccagaagtccctcgttcccacattctcttcctgtccccaaaggtaaccaccgttctgatttaccacagcagacacttgattctaaacttgattgttaaaatttgtgcaggacttccctggtggtccagtggataagaatctgcctgccagtgcaggagacacgggctcaatccctgatctggaaagattccacgtggcttggagtgactgagcccgtgggccacaactattgaagtctgtgagatctcaggtccgtgaaccataacaactagagcctgtgctcaacagcacgagaagccactgcggtgagaagcccacaaaccacagtgaagagcagcccctgctcatcgcaactagagaaagcctgggcacgataaccagaacccacggtagccaaaagtaacataaattttaagttttctttcaatttgaccagattttgaaatgacacaaagaaaatactgtaatattttacctttaaacttatagttcccattatgcatttaattacgatggcggtggtggcttagttgctcagtcgtgtccagctctttgtgaccccatggactgcagcctgccaggctcctctgttcatggaatttccgaggcaagaacactggagtaggttgccatttccttctccacgggatcttcccaacccagggatggaacccacatctcctgcatctcctgctgggcaagtgggttctttaccactgagtcacctgggaagcccgtatttcttcacattcctccaaattcagatgtcggagtcctaacccctaaacttcagaatgcagctttacttgaagacacggtcaggacaggcgcgtcccatcccctctgaagccgggcgggaggtacaggggggagtgtgaaagctcgctctccttggcctttgagatggaacctcttcctggtgttaccttttcagaggtgatccagttaagattatcagagtgggttctagtgcagtgtgaccgaatccttacagaaagggggtaactggtcatggacccacacacagaatgccacgtgaaggtgaaggcagtgatcagggggatgctcctacaagcccgtgaatactgaagactgctggcatccaccaggagctaggaggcatgaaagattctccctcaccatcctcagagggaatcatctctgagaggtgtctgcagacaccacgaccttgaccttctggactcccaaaccaggagacgacacatttcttttgtctaacccagcggtcctcaggggcaccaggagctggttccgtggaagaccatttctccagagactggggtgggagatagtttggggatgattcaagcgcatcacttctactgctcacttcatttctattatgattacatcagccccacctcagatcatcaggcattagattctggaggtgggggacccctggtttaagccacttggtttgtgggactttgtgatgggagccctcgcagactcctacagtccctctgccaccatctgcatgacttaacttccaaaactgcagtgttacttagataccgcagaaaagccctcgtatttctaagtgacattttgctacatatcagcattatttttcaagacttgaacaacactggcttccggctctctgtggttttactgagccaggttactagtgatgactgccctgccacgaccctccatggcgcccccggcccccacctctctggacctctcttttaggaaaaggagtctctggggcattagcccaaggtgggacaagggtctccctttcccccaaggttagacaagggtctcccttttccagacgtgatctctgcctgctacagtaaacgaagacggggagaaagtggcaaagtcataccatgacagcactagaatcctgagagggaagtgttttctgcttaggtcagctcctctgtttcctaggagaaaaagaactgggatccagaagaagaaagaggccaacacttgccctcaatgcccagacacggccccagagccaccccctagcccactcgtgtacaaccttgaacttcactccgctgttcctgttcacaccacccatcccctctgcttgtcctcctgaccagctgggctgaagcccacagaggcccggagtgggctgtccctggagaatctggcctctttcagcctttctcaccactttttctagctggccccattccactttgctaggttccaacggagaggagctgggtcatctagccagagcctgtaatttaattagctcaagtatctctgcggtttggagaaaacaaatggaaactagaaaattgaaatgctgtttccccattagcgtttctattgaaactctagccattaaatattgcgacaaatgttttaaaacgcttaccatgtattttcaggccaaatgcaataagcagctgagaaaaataatctagatgaaaaaaaaaaagaggcccctttcacattgtggctctgatacttttgagcacacaagcagtgtcgggtaccaggcaaccaaggacatgggcaccagccgagaggcttagaggccgcctaggacacacacttaggggacgtggcacacttaagtttgcattactacctgaggccctaaagagtcaaacaagaggcaggggagcctaacggcgacttctgtatcccctgaaccccagccgaggtgaccaccccccgtgcaagtgactgtaagaggtccctcccatagggcatggccatcaagggatggtaattcgatttgaatgctgtcatgcaggtggtccccctactttaaccaagctagatgtcccactggaatgttcgaccttcccaagacgctgacccaattccattttctgagactcaggccaaggtccacttgattatttcatttcttagttcagcaaatatttattaagcctctactgtgagccaggcatcatgcaggttctggagacactgtgaggaacaaaagggacgctgtcccagggaccctcctgatggtccagtggttaagagcccaatgcgggggaactcgggtctgaccccggttggggaactaagatgccacgtgctgcagggcaactaggcgctaaaactaagaccaagagctgtcagagaaatcagtaacgggacgcctgccctcctcttagggaagtcacagaccagagtgggagagagatgggagtcaaatcatcccagaacaaacagaaccccatccagggcatcagccccgggaggcaggaggtgtgtgacagcctgcactggagagatgcgacccaaaggcagaggtcagagaatagcaggggtccatgatgaaagtgaaagaggagagggaaaaagttggcttaaagctcaacattcagaaaactaagatcatggcatctggtcccatcacttcatggcagatagatggggaaacagtggaaagagtgtcagattttattttggggggctccaaaatcactgcagatggtgactacagccatgaaattaaaagatgcttactccttggaaggaagttatgaccaacctagatagcatattcaaaagcagagatattactctaccaacaaaggtccatctagtcaaggctatggtttttccagtagtcatgtatggatgtgagagttggactgtgaagaaagctgagtgccgaagaattgatgcttttgaactgtggtgttggagaagactgttgagagtcccttggactgcgaggagatccaagcagtccattctgaaggagatcagtcctgggtattcattggaaggactgatgctgaagctgaaactccaatactttggccacctcatgcgaagagctgactcactggaaaagaccctgatgctgggggagattgggggcaggaggagaaggggaagacagaggatgagatggctggatggcatctctgactcgatgggcatgagtttgagtgaactctgggagttggtgatggacagagaggcctggcgtgctgtgattcatggggtctcaaagagtcagatacgactgatcgactgaactgaactgatgaggacatgaccctgccattgcatctgaagacagagattaactcagcagagagagatcgggagaacattctggaagagaacaggatgtgtacagccctggaaaccaagagagcacagaagtctgaaggcccatgggactgagcatgaagcaagaagcagggggatgtccctggcggtccagtggttaagaccctgcacttccaatgcaggggccacgggttctgtctctggttggggaactaagatcccatgtgcctcagggagtgatcaaatgaaaatttaaaaaaaaaataataataataaggacaagaagcagggtggtgggggtgggaaagggtagctaaaagataaagttggagttgccggcagaagccagtccgatctgggacacggtggccacgtcacagttcgtcttccatggggaagaagcctttgaagggttcaagcggggaagcaatatggtctcatctgagtgtgaatagctcactctggcctgtgtgcggaccacgtgtagtcatgactgcattcatgctgaccaagaggggatagttaggaggctgtggctgaggtccacgcaagaggtgatggaggctggaccagggcgggaggatggggctggggagctccaggagtcaagctggcagaacatggtgtcagactggctcttaggggtgaacttgccatgtgcatgctcagtcactcggtcacgtccaactctttgcaaccccatgaactgtggcccaccaggctcttcagtccatgggatttttttttttaggcaagaatattggactgggttgccatttccttctccaggggatttttctcgacacagggatcgaacctgcgtctccctcatttcaggcagatttttcatccctgagccacctgggaagctcttggcggtgagggaaaggaataaaaaggcctctgcccagtaatgagggcgaggctgccatttggagacagagaacaggggcagggtaggagggctgctgtgggattggttcctgtgtgctgcgttggagacctacattcctgcaagaggagatctggcaattggccggtggggtctggagctcgagggtgtctggcccttcaccatctctgatcttccgctcgcaacccaaaagcatgtgcttcccagaaccaacccacacaacccaccccaccaaagcctcatctccaccctcaccatgctggagcctcacagtctcagaggaagggggcctgcagtccggggtcagggctagaccccacccgggttgctctgaatgcccgtccgtccccaccctccactgtgcttccttcctctgccctccaccctgactccttcccaaccccgtgcatccttcaagcagaggcggtcatgtccccgccccattcatcaccagcatcatccacggagagatctatgctcaccgtcttcactcccccaaatccaggcaatctcttctctgcccttccacttcctccacgacaagcagctgctcagccgtcaccacgggccattttatacttgacctttcccatgtcctccccaacatccttccctcctgggtctccggctgcccgaggaccttcactcgttcctgtcatcagcatctcctcttctccacctgcttgaatcgtgccatcccccaggctctgtctagagtgatcagcctcccccctccctaacccagctgcctaccccagccccgcctcgatgctcggggcggcttcattcacacacggcagctcagcaaccctgacacctgtatcactgcgtggtctgggccacgtcccacttgctttctgctgccacgatgaagcacagcccagcgggctccacattctatgggaaatccctgagcaggcaagggagcccccactggacagaacagtgaatgaggggtcctggggtgggggaccctcaccctgtgctccaggccctggatctggagatgctagcacgatctcttgacaagcatggatttggggttcgaatttgggataatacgatactagtctttactctgaaaccaaagaatcttggtattttctctcaggtacgtccttggtagcatcaggtcaccagagacagcagactggaaaggttcactcctgatcctttttcccgatcctcaccttccttactttcttctcctgatgccaagtgttacatacacatgtctttcagcatctcatttttattttttggtgatctgacagtagattccaactgtgactccattgggaataatccagtgagctttaaaaaatactgatccccggatttgggacttccctggcagtccagtggttaggactctgtgcttccactgcaagaagcatgggttcaattcttggtcagggaactaacatccctcacatgctacacagtgcagcaaaaaaaaaaaaaaacaaaaacagaaaacatcgacccccgccccactcctgccccctgagttccgatggaagcggtctgaggtgtggcccaggcattcacaagttgaaatgccccctggggattctactatatgaccacagctgagaaccacggtctggagactgaacaacggtggccccgctgtaagccgtttcttacaaagtgaaagtgtgagtcgcttcagttgtatccaactcttttcaaccctagggactgtagcccgccaggctcccctgtccgtggtattctctaggcatgaatactggtgtgggtagccattcccttctccgggggatcttccccacccagggactgaacccggatttccagcattgcaggcagattctttaccattctttaccattctttaccatctgagccacccatttcttaagggctcaggaaagtgagtaagtatttgtctctggctacttccatgtcccataacaactggcttcctttccagtcctcttcccataagggaaatccactcttcctaagaggtcccgggttttgctctggggagccactcacctcatagggctccttggtgggcctgcacctgtctatctggtagagctgggtcttgtagcagatgctgtcctggaagtcagatttctaccggagaagaaaagaaaaaaagcctggcttaactcttggaaaataggaatgtttaacaagcagtcgttaatttttaagccagtgcttggctgagaaacgacagaatgcggttggcagggcacttaagagcagtgcaaagactactccgtgggcagcccgcaggagcgtggggagaggcaggacccagcttcctggctctgccagaaaagggcttggtggccctgggcacgccactgctcctgctgcacctccgctctttcatctgtgcgacgaaggccacgctaagacgtgagctcagggaccgaatatgtgagctggggaggacaacttaactttatggaactactgaatgggatgcaggtcttgcttatttaaaaacaggcctaagaacttccctagtggcgcagtggataagaatccacccgccaatgcaggggacgtgggttcaatccccggtccaggaagatcccacaagctgtggagcaactaaacccctgcaaccacagctactaaagctgtgctctagagcccgtcctctgcaacaagaaaaccaccacaatgagaagcccgtgtacctcagccagagaaaagctcacgtgaagtgacacggacccagtgcaaccaaaaataaattaattaacctaaaaaatgaaatcaggcctaaaatggatacataacaaggacctactatatagcgcagggaactaactatatttgatgtcttataaaaacttacaatggaaaataatctgaaaaagaatatatatatatacaggtataactggatcactttgctgtggacatgaaactaacacaacactgtatcaaccagacttcaagtataaaaaaacagccctagttcctgctccccacccccaaaaaaagtcacagcaattcataatatagcttaaagaagaagatatataaccacacctaagatggtgtaggggtacgatttacgtacagtcctctctggcgacagctgaaattaaatgactgattaatgtatcagtcaacaaatattcctggaaggccttttcaggctctccaaattaaaatccatgcatctaggctttagaaagaagcagcaagaatcaagggagaaatggcaattaaagtataatattttactttttagttcactagttgccctttcaaaattatatatggttgttagtaattgcttaatgatattaataactggaatagtgccctgggtgcaattaaattagccttgcatggaaattactgagtggactagctatagttatttgtgggcaatcagttcagttcagttcagttcagttgctcagtcatgtctgactctttgcgaccccatgaatcgcagcacgccaggcctccctgtccatcaccaactcccagagttcactcaaattcacatccatagagtcggtgatgccacctagccatctcatcctctgtcgtccccttctcctcctgctcccaatccctcccagcatcagagtcttttccaatgagtcaacgcttcgcgtgaggtggccaaagtactggagtttcagctttagcatcattccttccaaagaaatcccagggctgatctttagaatggactggttggatctccttgcagtccaagggactctcaagagtcttctccaacaccacagttcaaaagcatcaattctttggcactcaactttcttcacagtccaactcacacatccatacatgactactggaaaaaccatagccttgactagacggacctttgttggcaaagtaatgtctctgcttttgaatatgctatctaggttggtcataactttccttccaaggagtgtcttttaatttcatggctgcaatcaccatctgcagtgattttggagcccagaaaaataaagtctgacactgtttccactgtttccccatcgattttctatgaagtgatgggaccattgtggggaataattcactcttaaaagcagtcacccacctagacactggttctcagaccatctatgtcttgtgatttaagggttaagtgtgaaacagacaataaaataagaaccgtcccctgttagaactatgttagtttccaccaggaacttctcagcagtgtgtgtgtgtgtgtgtgtgtgcacgcacgtgctcagtcgctcagtcatgtacactctttgcacctccatagactgtagccctccaggctcctctgtccatgggatttcccaagcaagaataccacggtgggttgccatttcctactccagcttctcagtagacaaaaccacaaagctttgcacactgcaacatttgcagctctgatgctgagtgatcacagaagatggtaagacaccctggagaaggcaggacacagcctaagagcttcacacaaatgtctctgactttgggatgagccccgtgattgtttaaccgggtctctacagaggtagatgcaagaaactattttttaaaacaaaagcccctctatcttattgatcagtattcggagaactgattctgctgaaagaaggaatctgcttgcttgcttaggaaagtagcagtgtcatcctttaaacatgtggaatcatgaactttatcggcagtttcctggaaacactttttaaaactcatatttgagtggcattcatcatttcaaaaagaaaattggtgtgtgaccctcctctgtcccttttacttgagaactgcttgtctctagcatggtggtctctaaatggtgtgaccttgagcccatatgagtgaaaaagttgtatcaacaatatgtgcatatttattttataaattataagcatgtactgtactaatatatcattataatatatacattataaaatactgtacattataaaatgtgcaataaaatggggatttaaaaggataaggaatatatgggacatgtggtttttttacaaaaccactagggcttccctggtggtccagtggttaagaatccactttgcaacacagaaacacaggctcaattcctgttctgggaggatcccacacgccatagggcaatgaagtccatgcaccacaactactgagcccacatgctgcaactcccgaggcctgtgtgcctagagcccgagctccacgagaagagaagccgccacaaagagaagaccaggcatcgaaactagagagcagcccatgcacagcaacgcagactcagggcagccaaaaatgaacaaataacaacttttttaaagaaataaaagagaaatgagaaatggcttcaagtctaacatgtcttttgagtccatcaccataggtgaacagaggacctctgttctctggggtaagagaatttcttaatccctcctatcacatagtaaaatgatataaataatacattatgggtcaggggtccagtctttttgacctccacttctctcctgtggcggctttcctgtgaccacggtattgtttctgaaatccagctgcatttctgctcccttccaaagtttcattccatccctgcttctagagcatgttttttttttttctccctcataaaacactgctctcatttttaacagccatttactataatgtttcttctcatcaaaggaaagtacctctttcctttgaaagtgaaagtgttagtcactcagtcgtgtctgattctttgtgaccccgtggactgcagccctccaagttcctctgtccacagaattctctaggcaagaacactggagtgggtagccattcccttctccaggggatcttcccaacccagggatcaaacctgggtgtcctgcactgcaggcgggttctttacatctaagccaccacggaagccctatgtctttcctttggtggctcacacaaaataaaaagtgcttctgtggataatttcacatcgaagccaaatctaggaaataccctaagctgaatcagcttagaaacacctatccttccatcgcattgtttaacaaacctcccatcaagcttcttgatctatttagcaatgttttctagacgtcttccaaatctatttgctaacaagagacacagtctaaccatcttgtcttctgggcatcattttggtcatttctacctcaccaggagaataccatttccccgactgtcagtgaattttcatctttagctctaattgggctatcacataactttacgtattttttaaaatttttattggaatacagttacttttcaatgttctgttagtttctgctgtgtagcaaagtgactcagccatgtgtatacacgtattccctctgtttttagatttccatcccatttaggtcaccacagggcactgagtagagttccctgtgctatatctcattagtcatctattttatacgcagtatgtgtgctcagtcgctcagtcgtgtctgactctgcgaccccgtggactgcagccctccaggctcctctgtccacaggattctccagataagaatactggagtgggttgcactttccttcttccaggggatcttcctgacacagatatcaaacccaggtctcctgcactgaaggcagattctttaccatctgagccaccagggaaaatagtgaatatatgtcaatcccaatctcccatatcacatgactttaagtagcactgaaaaactccagaatttcatcttcatgttttggattctgaatgtcttcctaacagtgatgacctcacacagatctcaaggcacacacacacagggtgaagaccatgcttcaagagagtgggtgtgaaatcacacttcagatgggcttcccaacaactgcacacttctctgcatgacttcttgttagatctggtcagccctcaccattctgagtaggagaaacagcaggaaagatatgcagaatccccactgcctctgatctagctttctttgcagatttctttttcagccattgttcatttggaaagagttgatttatgaagggcttccttcataagtgaaatcaaccatttcgctagtggtaaagaagccacctgccaatgcaggagacctaagagacttgggtttgatccctgagttgggaagatttcctcgagtaggaaacggcaacccactccagcattcttgcctggaaaactccatggacggaggaatctggcaggctatacagtccatggggtcgcaaagaacctgtcacgactgaagcaacttagccacacacagcacgatttagtcaaaaccctcgtagctcagtctgtgaagagtctgcctgcaatgcaggagacctgggttcgattcctgggtcaggaagatcccctggagcaggaaatggcaacctactccagtatccttgaccggagaatcccatggacagagagagcctggcagactacagtctatggggtcccaagagtcaggcatgactgagcaactaagcacacacacacagatatggaagcatgtaaattccctcacctgggcacttataaactgcatacgcagaaggatacctgtgaccaaagcatgagggtaccagggtccagcacagacccccagctgcacctccctcacctgtgacacaggatgcctgatgtccagactaactgaagaagccgtggtcgatttcactcttgttttctagagaagtcaatgtgaagagtggctttttcatctaccctgctttagaggtgaatatttgaggggctctgctccccagtttttatgatcacacaagccccagtacccctaagtggggaccccaaggagccaagagaaacaggaacaaaaaaggcaacaagaagctgaagggaaaagaagcttgagtctctcgcgagttggcccagagctcagctctgtgggagaatattttaaaaacatctcagataaaaagcactccccgagaagcaggttttgctcctcttttctaacacattcaggaaactcaacctcacatgagtttcaattaacagctcagatcaagtgtcggccactgggaaacacttcgggtgtcagagctctctcttttttttttttccatagagagcagagagaaccagcacagggccccactcacccctgacaagtagcgctcaagcttcttgtttaggaggaagtagatggcgaggatgtggcaggcgcggttggagagcacggtgttgatcacatcgctgttcttgtagcccagcttctcggtcatgtgcagcaccacgctggggctcaggtcttccagggaaatcctgctcgacggagggacaaagaaccagtcactgagaggctctggggtccccttaatgatgctcacaagcatggcagcacagaaaccccctcctaccctcaaacactcaaaggctccctcgtggacagttagtccactcattcattcacttgacttcttactatgaaccattaacatacacaacaaaagaaagggaatagtctaattaccctatatgtgcatgctaagttgctttagtcgtggctgactgtgtgagcctacggactgtagcctgccaggctcctctgtccatgggattctccaagaaagaataccagagtggggtgccatgccctcctccaggggatcttcccgacccagggactgaacccgtgtctcttgggtctcctacactaccagncanttctttaccattantnccatctntatatcaccctatntntntanccaataaaacattactttatcaacaaaattccatctaatcataactataatttttccaataataatatataaatatgaaaattaaactataaataaatctcaccacagaagaatttatncttttaaactatgatattagagaagnctcttaaanttcccttnnnctncacnnnnatccntcctntccttccttntnnntttccttccttnnttttctttctttccttttttttttttnctnntcctcctnttcttttnctccctnctnctttnntctctctctttnntcnntcccctttttctctttttttcttttttctcctctctatntnnncttctnnnnntntnttnnttnnntttcctcaccnnctccntnnncctnnntttnttnnntctctntnanttnntnntnnnctnnnnnncctnncntcctcctttaagtnncnttncnnnnntcnnncntnnttnnnncccctttaaagctgaactgagtgcctggttgaactaactgttagcactccgcctttctttctttctttctccctttcttttttcctttcctttctcctgtccttccttcttcccttcgcttccctctttcttcctttactaaagtatttcaaatcacaaactttttttttttcctaaacacctcaggatgcatctttaaaaaccaatgacacctcctgcaggatcataataccttcaaaacatccccaaaattttagaaatctcttaatattctctgatatctagactgtattccaatttccctattcatcccaaatttctttacaatctgacattttttttccttaaaatgtatttattgaactgggtagagcccatgtagtttgggtggatgttgggttgggaaagaagggtattcaggagccagaccagaccatgtttaaaggaacaatgtgagctctcaagttcacaaagaggggatttgggatgcagctgtgaagttggatgctctcagaggacaggttaaagcttctacacaggagtgatacgaagataaactcccttgggatagaatgccccaaaatgaatgccaggtgtgtatatatctacttatttgctcattcaagtccctgcttcatggagtttacatggcagtggggaagagagaaaataaatccatttattcttcacgacagtcttacaaagggtaccagagcttccctgatggctcagtggtaaagaaaccacctgccaatgcaggagacgtgggttcagtccttgggttggggagatctcctggagaaggaaatgacaacccactccagtatccttgcctggaaaatcccatgggacagaggagcctggcgggctacagtccatgggggtcacaaaagagttggtcatgacttagcaactaaacaacaacaacaaaccattattatccccatttaacagatgaagaaactgaggcccacagcaggaaagtaacttgtccaggcacacactggcaagaagtagcagctatgtagaacatgaaagcaggagaagggcatagggaatacatgtgttggtagtggaggtatgtcatcagatacaacattttacattcctgaagacagaggcaaggacaatactctgtgagcagaaagcaagcacatctggctagaaagctctgtagccctgccagaatctggagacatttttggtgggacctcagaaccataactggaggagggcaatggcaccccactccaatactcttgcctggagaatcccatggaccgaggagcctggtaggctgcagtccatggggtctcaaagagccggacatgactgagtgacttcactttcatttttcactttcatgcattggagaaggaaatggcaacccactctagtgttcttgcccggagaatcccagggacgggggagcctggtgggctgccgtctttggggtcacacagagttggacacgattgaagcgacttagcagcagcagcagcagcagaatcataacactaggaaaaaccacagggtacaaccctatagtggtgcagaagaagagaccaactggccaagctcacaaaggcagcaacggcagccctgggtctgttggctgttgtaactaggtcagctctccctcttctaggtctggctaagtgccacccaaagaaaaggtgcccgagaaacgacaaaatctgccttcctcactcctgttggctacaaaaattgcaaattctagaaacagtttggagtaggcttgctatgattaatggttaaaaataataacatctgttttaaaaggatacgattacttgaatgttgccaaagcacttaacacaagagaacacaactgttttaaaccacctggtaacatccatgtgcccctggccgtgcccttgatcagtgaaaccacgcctacttgaccccactcctggccaatgagatcactgcccttttatgttggccaatcagaccacagcctcatggccactccttcagccaatcagatcatgatatttgtgactccaccccagccaatcatccatggctgccgtttggatagctccactctctacctggagcaggtcctggaagggagtgtgctctgggtgtgagatgccaccagggtggggctggaggcagaggtgagaggagaaaagtgagcaatctctgcccttcctacccactgtcttcaaaaacaggtgaactctgccaaatgtagactggctcttgactaacagcaatattttgaacgttttcaatatgcaatgtatatattgagtgcctgaagaatcccatggacagaggagcctgctaggctatatagtccatggggtggcaaatagtcggacacgacttagcaactaaaccaccaccaaccatacttgtatcagttgttgaatttgtattacctctccaagtttcgatgatacaaacaatatttaaaaagtgttctagaatacgaggtacaattttgagtcaatatgtattaaagtcaatttcattccagtgtggtctaattctgtcctttgttaccaatgatctgctttccctcccacccatctccaggtggagacacagtcccaggcagggtgatggaggaggcagccaaggtctgctctagaaaaaaaatgtctgctgccagaacagagaggtgagcctggtatacagcagacatctgtaactgactggcgtgaacttattataaaaagtttccttttaaagatattttcttcttgcctcttgcaggtcaactcagaggcttgaaggaattaacagaaggctttacagaacagtgatagaaaacatgagacctttattttctctctttcccaacagtaaaacactgacaacatctaaaataattaaatctggggctacatatgttgagaagctataaaatagacttcaaagagaaaatactcctttctccagttgcatgttcttattttgtttatctgtgtcctgataaaatcagaaaaaataattatcaagggcactttttttttttttgcattctatctttttcaaaataaagactaaggaagacgtgtcttttctaatagtttagatttctggtttcattactttaaaaattggacattggtttgcctcgaaaaattggacattgatttgcctcattaaatgagtaatgagccttacctaaagagaaggcattgagctgctgctttccttcatatgcaagttctcaatcatttttacaatctacccaactagatcttaaacagcctttatgcctctgaccaagtccagatgtaaaaaggaccaaactggcagagctagtacaggtacctagaatttaagatttaatctacaaaaggctgtttataacccgtggagaagcgacaaaatgagcagggcatgaatctctgaatgaagatgcaaccggcaaggagggagggctgtatctctaatagctgcttcacgcccttcaacacctgctgcactgagggggttgagtctgctcatttaggtggtgattacattaggttaatgactcatttggccgccaccggtgcctgctcccttatagagagcagagctgtgtactgctaggcagcgtgagcctggtaatgaggctcggccccttggcttcgctttccatctcacgtcgggctaatatttctggtgtctatttctggtactagcccacatcgagccaacactggaaaccagcagtctgtttccaggttcccttggtaaccccagtcccctagactttgtttaaattacttctcacgagtcaaaggctagaattctagatggcagctctctctggccaaggcaagtgtcaatggggcccaggagccaggttgcaggtcccagcactgtccacccacgccctcggaagcccctcagagcctcctccccaggacagagctcttgtttggagaagctggtgctgcagctttcatagggctcggggcctgtttccagaccatcctgggcggatgtcacccccttccctgccctgttactgctctatgcgtcccccttcttcagtggctcctgcatcgtcacctgggcttcagatctagaatgtgcaggcccctctaggtctgaaggaagagggctctaggttggtctcagtcctggaaggtatttgacccctggggttttcacgtttgctctaaagtcaccaaagggtgggaggcttccctggtggtccagtggttggggctacgccttccaaggcagggggtgcaggttccgtccctggtcaaggagctgggatcccacatgcctcagccaaaaaaaccccaaaacacagcacagaagcatattgtagcaaattcatttaagactttaaaaaacaatggtccacattaaaaaaaaaaatcttaaaaaaatttttttacaaaataaagtcaccaaggagggggtccttattcccctaactcagactagtgagcagtatgtcaaacgagtaggggagaagtgcaaggaagtatcttcctgtgtgactctttgccaccccatgtcgccctccaggctcctctgtccctggggttctccaggaaagaattctggagtgggtagccattcccttctccaggggatcttcctgacccagggatcaaatccgggtctctggccttgcagacggattcttgactgtctgagccaccagggaagcccaggattttcctgtgcttgtttacaagtctgtagtcgatacccccactcggggacacgtggcccatcacaaggtgtccctcagtgtttccatactgtgggctcctgcctggaagcttcctcatggactccttctcgagcaagcggcacagggaaacttgggctgaagcctttcccgcctttcttcctgcccccaacatttcagagcagggactcagggctgaaacaaacatcagagcaaagaggtggcagaagaggagcttgtggatcattttgaaggaacgggggcaattccactggattccaaccgatgctggcaggacagctcttgagtggaacacacacacacactcatacacacactcagatacactcacagacactccagcagacacacatacacactcccataccctcacacacaacacagattcacacactgaaacatatacacagacatccacaacccacaaccaggcatactcagacacacacacactcaaacagatacacaaacagacactccaacagacacacatacacactcacataccctcacatactcaaacacagattcacatactgaaacacatacactcacacacagacacccacaaacaggcatactcagacacacacacactcaaacagttacactcacagacactccagcagacacacacacacactcacataccctcacacactcacacagattcacatactgaaacacatacactcacacacacaggcatactcagacacacacacacactcactcactcaggccttagctcgtctaaacagtccctctgtgtgaattagaaagaggtgccactcaagagagacagaggccttcagcagcaggtttgaggaggggagagtagcctggacttcagcccccacgtaccctctggcagggccccctgaagggtgcgctctgcacgaccacgtgggatggccccacctatacttctcctggtgcacggaggggagccccacgtgcggacttgtgggtgcagaggggcagggcagccaagagaagatgtggccttcccttgagtcacatagagcatcctgtccacaactattcagggcttgtaagacaggccccatgtcgcctgaggaggggtccctctgcgtgcactgagtacctgttgggataggtgatgttacacggcactttgcccacgtaattctcattcagccagcgattcgccagcgcctgctgaatgttgggcctcttcacaggatctggttccaggagagaacgcaggaagttcacggctcctgtgaagacattgggcaagtgtcacatctgttacaggctgaaggcagaccaaggcaggtgacccaccacacctcccgggccactgctcatctattttctggatcttggggggccacccatccagagtacaagatgtctgtccaaggaggtatctggcacgtggtaaagcaggaactggcgtgggtctccccacacaccatacctccccaacccttgtgctttctcttgtggtttaccactaaaggtgagccaaaggggaatggacgaatgtgaaaggacaacactgggtctcaaggtaggttttaaggaatttatacataggcctttcaggtggcactagtggtaaagaacccacctgccaatgcaggagatgtgagagatgcaggtccgatccctgggtcgggaagatcccctggaggagggcatggcaacccattccaggactcctgcctggagaatcccatggaccaaggagcccagtgggctatactccatggggtcacaaagagttggacatgacttagcgtctaaactaccatatatatgtgtatatacttgtatatatatggaattccctggcagtccagcaactaagactctgtgttcccaatgcagagggcctgggtttgatcccttgcaagggaactagatcccacatgccacaacttaaagatcacacatgccacaaccaagactcagattctttttcagattcatttcccttatagatgattgtaaaatactgaggagagttccctgtgctatacgtgcatcctttaagattataacaatggaaacaaaaatacaacactaaagaaaatgtttataatgcacataaaggtcacaggctccaaaattgttgagcatgagaatatgcagatcctcatatggacaaagactgccagggattccctgaaaatgaagatgctctgtcttgcttgagtttggggaccaggatgttttcttatttatactcattttataaagcactgtgatagtatccttgcaatagaaaaaatattcctttatgtaattttgtacatgatatcccatttccaatataccaaataaaactttgaggaaactaatctgaatttgcttggtcaccaaactttttaaatctttttccctaaagctattttttagtttcctaagataatccatatagtaaaggctattgtctttccagtagtcatgtacaaatatgaaagatggaccataaagaatgcagggcgccgaagaattggtgttttcaaactgtggtgttggagaagactcttgagagttccttgcaaagcaaggagatcaaaccaatcaatcttacaggaaatcaaccctgaatactcattggaaggactgatgctgaagctgaagctccaatacttaggccacctgatgagaagagacaactcactgaaaaagaccctgatgctggcaaagactgagggcagaagaagagtgtgacagaggatgagatgattggatggcatcactgattcaatgaacatgaatttgagctagctccgagagatagtctaggacagaggagcctggcatgctgcagtccaaggggttgcaaaaaagctggacatgacttggcgactgaacaatagcaacaagataatctaacctttcaatgaaaagtcataaaaattgtcaccttctcacaggcttcagttgtcatttttaaaactgtcctttgaagaatgatgggtattatggtcaaccgtctttgcagggtaaaaatgaagctgtcaagaggggctaactctgatgccagaaccaaccccaaaggaaaaacttttgctaggtcaggccaccaggtaacccctccataggtttccaagcagtggatgaggccactggaaggccatttccttttgagaatgcagtgggtaaaaatatatgtgtagatgacaaagcagacatgagaggtatttaatattctaagttttatagctgggtctccaaatacatcttttctacaatgttcttcagtgctctgaagagcaaatggggctctaaaagaggggtctctcttgttggaacctccacctcccttctctccacttccctatattgtaaggtcatttggatgcttaatcgggacatctattggtcaaagaaaaaaagactgtgagcataatgagttgaaaccaggagactcttcagttaatgatgtttctgagacatctctgctgttgtcattgttcagtcgctcagttgtgtccgactctttgtgtccccatagactgcagcacgcggggcctccctgtccatcaccaactccccaagcctacccaaactcatgtccatcgagtcagtgttgccatccaaccattttgtcctctgtgcatcttcttgtctcttcttgtcatcttgtcatcaacctcttgtcatcttctcctcctgccttcaatctttcccagcatcagggtcttttccaatgagtcagttcttcgcatcaggtggccaaagtatcggagcttcagcatcagcccttacaatgaatattcaggactgatttcctttaggattgacaggctggatctccttgcagtccaagggactctaaagagtcttctccaacatcacagctcaaaagcatcaattctttggtgctcagccttctttatggtccaactcttacatccatacatgactagtggataaaccatagctttgactagacggacctttgttggcaaagtaatgtctctgctttttaatatgctgtctaggttggtcataacttttcttccaaggagcaagcgtcttttaatttcatagctgcagtcaccatctgcagtgattttggagacccccaaaataaagtctcttgctgtttccattgtttctccatctatttgccatgaagagatgggaccagataccatgatcttagttttctgaatgctgagttttaagccaactttttcactctcctctttcactttcatcaagaggctctttagttcttctttgctttctgccatgagggtggtgtcatctgcatatctgaggttactgacgtttctcccagcaatcttgattccagcttgtgcttcctccagcccagcgtttctcattatgtactctgcatataagttaaataagcagggtgacaatatacagacatattcctttcccaatttggaaccagtctgttgttccgtgtccagttctaactgctgcttcttgacctgcatacagtttctcaggaggcaggtaaggtgatctggtattcccatttcatgaagaattttccacaagtacttttccgctatcttcttgactaatattgtcatcaacaggagaatgttggatcccaccaaaaaaagatgtcccatatccaagggcaaaggacaagctccaacaagacagtagaaggggtgaaacagtgtttagaattaaaccccatacccaccacagacgctcagagggctcaaacaaaagcttgtgtgcaccaggacccagagactccacaagagactaagccagacctgcctttgagtgtttgcgtgtctcctatgcaggcatgggtcagcagtggcctgccatggggacaggggctcgggctacagcaggccttggaggcacagcatggctccagtcctcttggaggaggtcgccatcagccccaccatagagccgccaaccagacgacccacaaaccggagaacagttatcccaaaaaagttctctcactgctgcaaaagttccagggcccacaacagacttcccaacctgggggtctggcaaaggggctgagaacccccagggaatttgacttgacggccagtgggacttgattacagaacttccacaggactagggaaacagactcttagaaagcacaaacaaaaccttgtgcacaccaggacccaggagaaaggagcactgaccccacaagacactgagccagagttacctgtgagtgtccaagagtctgcagtggatgcacgggaagacactggcctgccacaggtcaggggcactgaatacaagagttccaggagccatggtgtgctggcctacgtccttttgaaggaggttgccattacccctaccgtagtttggcctcacagggagggaacacagctccatccatcaacagaaaactggacatctctgttgcttaccctcaaaggacctaaacagcaacccaggctttttcagagtttgattacccagaagagctaagaacagactggatgtgagtttttgttctattttcagaaccaagcactctgcaccatcacaaattgctgatgagcacaagtaattttagttcagatctctaccagtgaattttctttctttggacatcacaaatattgcattagtatccaaaaaggactttgaaaacatccttggagctctttgaagtctgtgtgagggtcttgaatatccctatgactcatgagcaaaaggcataaaaatattttccactgttcaggaaagctgtgggggccatggccacacatcccacccagcacttctaagctagcacttggtcttcagagccaggcatagggatgacccacccagggtgtggtccctctctgcgccccgtgtcacagaaggtacacactcctccagtgcaaaacctgtttcctccaagcatcagctttctggagcctgggctggcttgtgtgagctccatgagcccgtgccttggaaaagagccccaggaggcaggcgaagccatcaaattctttgttctattgcagcctgtgggatgctgagagagatctcacccgtaccagaggctccttcaccatcagctcccaggagaaagcagcaacagcaattatttgacgattgaggcttctcggaaatcctttttaccctatctatatatattcttttttagattctcatcattatagtttattacaatataatgactatagttccctttgctagacagtaggaccttgtttacatatagtcgtgcatatctgttaatcccaaactcctaattatccctccctccttgccctttggtaactataagtttgttttccatgtctgcgaatctgtttctgttctataaataaattcatttaaatcattcttttaagatttcacatataagtgatatcatatgatatttgtctctagctatctgactttgtatgataatctctaggcctacccaagttgctacaatggcattatttccttcctttttatggctgagtagcattcccagggtgtgtgtgtgtgtgtgtgtaccacaatttctttagtcatcggtcaatgaacatttaggttgcttccttgtcttggttattgtaaatagtactgctacaaacatgtatcttttcaaattagagtattctccagatacatgcccaggagtgggattgatgatcatatggtaattctggcttccccagtggctcaggggtgaagaaaccacctatgatgcaggcaacccaggagatgtaggttcaatccctgggtcgagaagatctcctgaaggagggcatggcaacccattccagtattcttgcctggagaatcccatggacatggcagcctggtgggctacagtccagagagtcacaaagagtcaaacacaactgaagtgccagcacacatgcacgcatggtaataactctatttttagtttttagggaacctctatactgttctccatagtggctgcaccaattcacattcctacgaacagtgtaggatggttcattttttccccacaccctctccagcatttattatttgtagactctttgatgatgaccattctgaccagtgtgaggggacacctcattgtcgctttgacttgcatctctctaatgagtgatgctgagcatcttttcacgtaaaatcaattggcactgacatgtccctcgcagatgctaacatcccgcctttagtatcacctcagtgacttcatggtgcaaaacccgcttgatctaaagtgagtatctggaatgcgttcagaacgccttccttgaggtgtagtgataaaaaaggaaaacatggaagctgtgaaaggcattcacgactctgtgatgtacaagcaccaacaagcacaaagagaaactgtctagaagccagaattggaaagatcccaacagcttaagctttcgaactacatggtggggaagagagacgattcttggaaagcatgcagagcagactcaaagggcaataacactgtgctctttttcagctcaaatttggcaaaaattcttccaacttcacctaaaaaaaagtgttgttatacagtagatatggagagatcattacaagtatgagtgatataaattaataaagatgtgttaatgagacacttaataaaatggcacattctcaatttggatatttcggttttgatattactcaaaacatgaggacaacagataacactgccaaatctgcagtggggaggggaggggggcatcttacacaaaataaagtaaggaagaatagagaagcaacatttcatacatagctcagttggtaaagaatccgcctgcaaggcaggagaccccccagttcaattcctgggtcaggaagatcttctggagaagggataggttacccactccagcattcttgggcttccctcgtggctcagctggtaaagaatctgcctacaatgtgggagacctgggttccatccctgggttgggaagatcacctggagaagggaaaggctacccacttcagtattctggcctggagaatcccatggactgtatagtccatggggttgcaaagagtcagacacagctgagtgactttcactttcaaagaagcaaccgagtacaggagggaagttcagatttgggggtcaaggggaagtaaataaaaactggagaagctatataatcttgctgggactcaagtttcctccttgataacttgggaataatagagcttaacttacagagttgttatgagaacagaagacactatgaaaagcacttacccatggccattcaataaatggcagccactcctgctgctggaagctagtattctgggacgtaaagaaactggtgtcacacggtaccacagatgagggtgggccagcatggtggaaggaaaagtggtcaacttggggtgcaaataacaaagagctggaaaagcagggggctgacagaaagcagaggctgatccccagaactgatgtccttcactctataagccagagaagatgacctgagcttcctcagcatcgaaggtgcagttctgggccctactggatcgggccagatctcacagctgagtagccaaatgagtctgtgggctggcttcccagactacacactttaacacaagggccagggactcagattccctgaacaaccactatgtgcccacactatgcttgatagcacaaacctggcacaaaacgttaaagcctgaggtgggtagatatttacatatcttactattggagatcagtcctgaatatccactggaaggactgatgctgaagctgaaactccaatcctttggccacctgatgtgaagaacttactcatttgaaaagaccctgatgctgggaaagattgaaggcaggaggaggaggggatgacagaggatgagatggtgggattgcatcaccgacccaatggacatgggtttgggtggactctgagagttggtgatggacagggaggcctggcgtgctgtagtccatggggtcgcaaagagctagacatgactcagtgactgaactgaactgaactgaaacacttacccatcttaggctttaaccctctgtgttggaatagtaagagaataaaagggggagtgaaagtgttagtagctcagtcatgtctaactctttgcaatcccatggactgtagcccaccaggctcctctgtccatgggattctccaagtaagaatactggagtgggttgccatgcccttctccaggggatcttcccaaaccagggatcaaatccaggtctcttgcattgcaggcagattctttcccactgagccatcagggaagtcaaaaggggaggagggcgatgtccacattcctatatcataaaatcagatatataatgcataaaatcagatataaaaatgcatttcatgcttgttcatgcttgaccaatcaagactataaggtcctggacagatatgaagatctctaaaaagcacacacagagtttaagttcagttcagagtttaaggccaaagtcaaaattgtctgttccaagcaagagctacgtgagactggatatcaattccaatcataccgaaattgcttggaacatttctaatatttcttttgctccctccgacttaaaaaaaaaaaagatattttcagggtgcaacttttacttctttgaaggtaatttaattgtcacaataagaaggcacttagagcctagtctgctaatgctgagtaatagtactgggataaaaacaaggttggttcagaagcaacgaaactgatttccttgtgcttttagtccgcctgtccttgccctgctgcccaaaacaccccagtgccaatgtcagggaccccctcctcccacagcctgtggctcacacgagtaatgctgcttaatcagatatttctggcttttcaccttccagatacatggtaggattgcatttcctcagctcctttagctgggtgaagccatgtgaaatgttttagaaagttacaagttatgagtggaatgttggtgggagatttcactgctgcaaagagaccttctagatttctggttccctctgcatggatcagacacattggaaatagtggctgccccagtggtctgggagcctgattgacaagaatgagcagaacccttcaacctttgatccacctctccacagatatgtagcatgaatgagacatgaatctcggttgaattccctagttgttcagtggttaggactccaagcttccaaggcagggggtatgggtttaatccctgcttggagagccaggattctgcatgctacatggcacaaccaacaagaaaaaaggaatctttgttgtcttatgccactgagatcagggggctatttgttactgtagcataacctaggctatcctgactagtacaatgagaagcagctctagctcttcagggtctcactggaattcagagtgaacactgtctgctttttccaggcatgaagttagaaacaacctcctattgttctttgtattgggacactttagacaaaacaggcttgaacaataagaggaacttcaaaatcactctgaaagatggtagtcctatgattatataactcttaaagagactaccttgaaagactgcatttatttgtaagtgttaaatcttatttgttaccacaatgaggtatcattatatccctatcagaatggctaaaattaaaaagtgagagtatcaaatgctggcaaggatgcagagaaactggatcactcatgccttgctagaaagaacgcaaagtggtacagccactcagaacagaaatgtcacagttgcttacaaaaccaattatacgcttattataatacccagctatttcactcaggcaagtgaaaacatgttctcacaaaacctgtatacaaatattgacagcagattccttcatagcatctggaaacaactcaatatacttctgtgggtaaatatatacactatggtaaatctataccatggaccactactcagcaagaaaaagaaacaaaggattggtgtgtgaaatgacttggatggatcccaaaggaattatgctaagtgaaaaaaagagatacaaatatattggatttttgaaaagacaaaattacagaattggagaacaggttagtggtggccaggggttaggcaaggtgggaggcagggagctggctgaggctatagaagggtaagataaggaattctggtcatggaattgttccatatcttgacttaattatcacatgaatctacacatgtggtgtgacactgcagagaattcaatacacgccaacacaagtgcatgttcgtccaaataaggccaatggcttttaatcgcatcctagtggcaaccctaaactgcagttacttgagagcctatcaacggggggaactgggtgaagcacaaacacacctctgcgtgatttctcacaactgtgtatgagtccacgcttatgccacaacaaaaagttttttataaaccctgagtggctaaaaaacaaacaaaaacccaactgtatctttattctctgtccccttatcctggtttatcttctttatttttggctgttctgggtcttcattgctgcacaggcttttctctagttgcagcgcacaagcctgtctttcttgtggagcagaggttctatggcgtgtgggcttcaggagctgtggtgcatggactcaggagctgtggtgcatggactcaggagttgcggcttccacctctagagcacaggctcagtagttgtggtgtgggggcttagttgctttgaggcaggtgggatcatcctggaccagggattgaacccgtgtctcctgcgttggcaggtggattctttaccacggagtcaccagggaagcccctttctaattttctttagaacactgaaactactaaacatcacaagtgtttatctgttattttttgcctcctctgctgatatgtaagctctacatggatagagactgttttgtcttcctggggcctagaacatctctagcagcaagttgatgcccaggatcaatttgtggaataagtgaataaatgtgaaatatgaacgaatgaatgtgcttccattgcagcactttcaacattttggcaagctgtaaaacctaaaccaaacaatttgatcaacattttgcaccctttctaactccatgagttacaggtctcaatgcagaactattccttttataacaacagaaacgtaactcatcttcccaagtacataatgcctgctttgctttcagcctccagagattcaacacgcctcggcagaggtgaaagaatgaaccgaattagataattatagaagaatgcatttcagcttgggtgtcatttggcaagcataaattctaggtcagcttcatggatgctttataaactcaagcaaaaaaaaacacaccaaaagcctaatagtagtcaaacaaaaatgccatatttgaaccatgtgtcataagttgaaatcaaataattactcctttttttcttttctggccacatgccttatctcagtgaagctgagtttattctaaggagccaattaaatgaccatcaaggccaagccgaggccaggaacttgaagtgaattgcaaaccaaacaagagaacaaactgcagtcatttcctggatctgaaaccaaatcttaatatgaactgtttactgaaatgtgaaccagctaaagtttgagagtaatttccaaacacacctgaggatttggtctaatcacgtaaccgaacccatatatatttaaaagcttttgaacagacttggaaactcacattgctaaacaaatctcagaacaaactcaaatgaaactaatagttctttacagtgagctgactaaggaacacacaatagaaatgtgatgatcgaccttcttttttccgagtcaacattataatgagttgagttttaacacaattcagtctgcaattatttttccaagagggactatacgatccttttgataggtgtgtattgtgtgcaggaggaggaaggaggaagttagggggtcgggattataatggacaaggaaaggactcagaggcgatgaagcgaagtgtgtccttagagacgggaaacccaaccgtttctggagacttcgttttcatactaggaagagacaaggcagtgacagggtcgtccagaccccaaagctgcaggagacacactgcttccgggggtcggagagcggccctggaccctggggcggcaggtgcgttacctgtggagagctgggcggggagcgggttcatctccttgtccaccatcttctggtacaaggccctcaggctgaaaggctccaccgtgaaaggcagggtcccggtcagcatggcatacatgttcacacctctggaaggagagacacaccagacgtgagaccggaagacgagccgggaagaagacagagcggccaggggcgtggggaagctgggtcctgccgcctccgcgtccacctcggcgctgctcggccattcctcgagcgctcagctctgcgctgagacaggaggtgtgaaaggcacgagcgaaagcgcagctgcggagagtcggaccgtggtgacaacaggggtttaaagagcgtcaagatgacacaaatgacctatttttataaaacagggacagactcagaaaagaaacgtggggttaccaaagaggagaggcagggggatgacttaggagtttgggattaacatacacacactcctataacaagggccaactctatagcacagggaactccactcaatattctgtaataacctctatgggaaagaatctggaaaagaatgaatccatgtatctgaataactgaagcactttgctgcacacacacaatatcacaatattgtaaatcaactatcttccaaaataaaaattaaaaaggaataaattcagggactttcctggaggcaagactccatgcttccactacaggggacatgggtttgatccttggtcggggaactaagatcccacgggccgtggggcacagccaaaaaattaattaattaatcaactttcagaaagtaaataaagagcttcagaagctacccccataaggaggggaaactatgtccttttcttctggaaggaagtccagaccaaatgatgtgaaaaatgcctgtgtaagtaggaacctcgaataaaagtagttccgccataatgcagttttcaagtatagttgacgaggtggagcctggaggaggccagatcaaaaacatacacggcaagaccctccacgggagggcaagtcacagtctggccaggctgcgtggctactactcagcccttggagacagaagtctcacacccaaactggtgtttcgctcttctcttgaactccgttttggcctgtacctagagaaattcctttggaggtggggaggaagggagatctctttcccactcttatttttcgtatcattttttattgggagattctgccatccagctcacatgtggtcaaaatgccttccgaatgggcttcactacctacagccaaaaccaaactagagaacagtaacatctcttggaggacttttcttttcctgatgtgcaaaacctaatatcattttgatgagatttcctgatggggtgaaatgcctggcctgccgcgagatctcgagtgctcaaaagcgcgcaggggagtgttttaaaaagaggcaacaagatctccagtcaaaacaaatccaatgagactgattgaaatgaagacccgtggggcctgttccactgaggtgcctctgaattacagcactctggagagggacaggtccagaatccacgggctccggctagaagtcattctcgaattgcaggcgtatgctaagacccagttcttgctttgtaactcgaagtggagttaaggagacggatacagcatcattcacttctcaatgcttgcaggctggctctcagtctcatgcagcagtattgatggctggcccccggaggggataccagacaaggagctgccatctcagactcagaactgggtgaaggcagacaaccagcaaatcaacaaataaataagttcaagtgtttcaagtagtgagtgccgaggggataagaaaatgctgaactctgcggctctggaccccagaggagttcaattaagggagagagacgactataataagtacttgaagatgggagccctctcgggataagtatacgtgtgtgagtttatctgtctcggccaactggttacgaggataaattatgtggaccaagcagtggagacaaaagggcttccctggtggtccagtggttaagaatctgccttgcaatgcaaagcacaccaattcgatccctgacccaggaagattccacgtgctgcagggtaaccaagtcaatgtgccacaactatggaacccactcgctgcaaccaccgaagcctgagtgccctggggtctgctttctgcaatgagaagcctgtgcaccgtaacgacagtagcccccacccgctcagcaacaacaacccagcacagccaaaataaataactaaataaatatttaaattcttaaaaaggaaatgcaggtaagaatgaacaaagcatatccagcactgtttaaagcagcatttccctgtgtgtgcttagtggaacaccatcctcaagacaagactagatgttgggtggataaactttctgtggccaaataatttgcagagcagtcatctggcatgaagtgggtgaaaggggctcagaatggggaccagcagactgaggcacgttgttcattaagttctgaacgggagggacagcatatggtagaaagagagaggagaaaattagcaatagggacgtttgaaggggagacgccaagacgcagcgtggaaagccggacgatggtggtgatgtaacagaagccaggaagccgggaggagaggtagtctggcggcagaggaaaaggggattaggggaactaacctgtttgagaaccttcaatgcactgctgcactgtggatacgtttgaggcagagccaaccatccttgcttggaggattcttggaggctgataaagcgagaaagctaagagggccctccaaattgtaccatttgtgcatttaaaggggtcttggacacatggctcttggggatggaaatcccgtgggacactccacaaggttgttgttggggaccctggtgaagcttcagagtcaagctcttccagcctcctaaggcagctcaggccattcagggcaacgctacgcatgggcaagggcttcaaatactgagccggagtctacaactcctacccgtcagctgtgggaccagccagtcctgtccccactcacctcggtatgcattaattctcgctctgacactcatatctaaagctgaagagtctggtacttaaacaaaattatttttcccgcaggtggtttttttgatactcaatctgtgtagtaggcttccctagtggctcaaacggtaaagaacctgcctgccatgcaggagactcaggtttgatccctgggtcaggatgatcctctggagaagggcatggcaacccactccagtattcttgcctggagaatgccatggacagaggagcctggagggctacagtccaaggggccacaaagagtcgacacgactcagcaactaaacaacaacaaactgcttctttgaccacattcaccccaggtttcacttctctcggagaagtttaccatcaacaaaaaccgtcataaatctgtaaagaagacccagctctctatccagcatcttttacctataaaatatggatagtaatagaccctacctctcaggtcgtatcagggtcaaatgaactaagccacagaaagtactgaatgccatgcctgacataatcttagtgcttgataaatgtgacctattgtttcatcacaaaactttttaaaaacaagagacaaaaagctacaattacatttgtaccctattgccaaataataatggaaatctacattaatagtcctatggccgcagtacatttgaaaagggaaaccagcctgagcatcttaatccccctcccctagagttttcatacatgtttaatatctggataaggaaaatctagcccctttgacatttcggaaggatgtgagaataccaagggagaaatgtggaatgcagtgtataaacctccataatcccacagaattagtagaagtttcaaaacacgttcagaatttcctgatgtgtcttttgaaacatggcccaggggctttctcgcttctccctggcagacatggggcccccaagaaccacaaagagtttgaaagaaagtaacgagatgtcgggacgaaggagggcgacctgcgtgcatgctcagtcactcagtcatgtccgactctgcattcccatggaccatagcccaccaggctcctctgtccatgggataatactggatatgggttgccatctcttcctccaggggattttccagacccagggatcgaacccacatctcctgcattgcaggcagattctttaccactgagtcaccagggaagcccaaaggaggccaacaagaaataaaattcaaggcttccaaacagagagaaataagggtgagtcaccaacagatgcaagccaatccagagacactgactgggtggaatactctgatgtcaaaagagaaagaaaaagtgcaccagaagggtagctgcaagaagagaggaaggggtcccgggaaaagtagacgtggaatctttgggattaaaccaggggccaggggacatccctgatggtccagtggttaagaacttgccatgcgatgaaggggactcgggttcagtccctggtcagggaactaagatcccacatgccaaagggcaactaagcccgtgggccacaactagagacctcatgtgctggaactactgtagccggcactctacagcccttgcgacacaatcaagacccaatgcagcaaaataaataaatgaaaataatttttttaaaagattaggagccaagtagtggtcctgatatttagtctaatacacaaaaatactccctggagggaaagctagggtatcacttggcatctccgaaaggaaagaccgaggggctcaggtccctggagaagtcaaccagcaactttaacaaaaagagacaaagtaatttgcagagctgtggtgtcagggagggagtgaatattggttcttacagggctggtgggcagctcagcttacaccagagggaagctgagagaaccttcagctgacatgccttgcttccgtgtgattcttcgagaaagaaactgcctcataaaaattaaaaataattctctgcctaaaagcaatagccttccacatttcagtatcagctttcagtacaacctccaatttaaggtcttaaaaatagagtgggaacagatccatccatttggaaaatcacggagttcactactacagcattatatggtctgtgttcagcaaaagattattttcttgtggattttaagacttcccccccttcttttcctttcttccctcttctcttctaagtgtgcatgctagctccaaaaacaaaaagtcttggattttgtaactgaaaaatctctgaagctaaagaaagtttctcttctaaaagtcaatgtgcatgtaacccgaggaatccctcctccctcacctagcttttaaaaattctttgccaaaaccctttggggagctcaagactttttagggcataagccacctcatctctttgcatggccttgcaatgaacctttctctgatccaaaaaaaaaaaaaggcaaaagctctaaactacccaaaagaagtcatcaggttattctttctgcctgtttctcctgccatctttcatttgaagggagcctgaatggagacaaaatgctatccttccagatttgagtcctggaagtagctggtggtgtctggtgtacttttacaaaacagttctggggactgaaacgaattctccagctcttcctcctgaaaacctaggtttacacggggatagaactagaaacaagatggcgcccctcagccaacttgtttacccaaaaggacagcactgggacagatttttcccactcagtgtgcctgagaagatggcctagatatttgtgcagggcactcaactaagctccaggtcttcacacaaatgcttcccccactccagatggccccataagagccaagagcagctttggtgaaaaaaaatgttgtattctcaatctctggaggacagaactctccattctccttttccctacccttagagactctccagagttctccagagagcactgtaatattttgaaaattaagttagttttgattcttttcatttaaaaagtatacctgcattcaagtttttttttaattagcatttatgccacttcgaggaaaagccagtcaacagtaaaaaaaggttcactgcaacagaatgaacatttagtttttgtctctgaaatttcaaaattcattggagataaagatatagatatttgattcatatagattaaagggaagaagtgaattattttagagatattcgtatatgatccaaatacaaaaacattgactgttgaaaataatgggaattccccaagatgttgctgttgttcagtcactaagttgtattctgactctttgtgacctcatggattgcagcatgccaggctcctctgtcctctgctatctcccagagtttgcttaaatttatgtccattaagtcagtgacgctatctaactgtctcaacctctgtcacccccttctcctcctgccctcagtctttcccagcatcagggtctctttcagtgagtcagttcttcgcatcaggtggacaaagtactggagcttcagcttcagcatcagtctttccaatgaatagtcagggttgatttcctttaggattgattggtttgatctccttgttgttcaaggactgtcaagagtcttctccagcaccacaatttgagagcatcagttcatcagcactcataattaagaccctattagatcagatcagtcgctcagtcgtgtctgactctttgtgaccccatgaatcgcagcacaccaggcctccctgtccatcaccaactcccggagttcactcagactcacgcccatcgagtcagtgatgccatccagccatctcatcctctgtcgtccccttctcctcctgcccccaatccctcccagcatcagggtcttttccaatgagtcaactcttcgcatgaggtggccaaagtactggagtgtcagctttagcatcattccttcaaagaaatcccagggctgatctccttcagaatggactggttggatctccttgcagtccaagggactctcaagagtcttctccaacaccacagttcaaaagaagcaattcttcagcgctcagccttcttcacagtccaactctcacatccatatatgaccacaggaaaaaccatagccttgactagacgaacctttgttggcaaagtaatgtctctgcttttgaatatgctatctaggttggtcataactttccttccaaggagtaagcgtcttttaatttcatggctgcagtcaccatctgcagtgattttggagcccagaaaagtaaagtctgacactgtttccactgtttccccatctatttcccataaagtggtgggaccggatgccatgatcttcgttttctgaatgttgagctttaagccaactttttcactctccagtttcactttcatcaagaggcttttgagttcctcttcactttctgccataagggtggtgtcatctgcatatctgaggttattgatatttctcccggcaatcttgattccagtttgtgtttcttccagtccagcgtttctcatgatgtactctgcatataagttaaataaacagggtgacaatatacagccttgacgaactccttttcctatttggaaccagtctgttgttccatgtccagttctaactgttgctttctgacctgcatacaaatttctcaagaggcagatcaggtggtctggtattcccatctctttcagaattttaagaccctataaatactgcttattgctaagccagcttgtatattatatgtaataggatattaaaaatgggaccccccctttttttctctctcagtttaagctgaatctccaggatgataaatgctgttgattcttataacccaaagtgagacctgaggcttcctgagcaggacttacaatggagaatcttctttatggtcaaactctcacatctgtacataactactggaaaaatcctaacattgactaaatggatctttgttggaaaagggaagtctctgctttttaatatgctttgtaggatggtcatagctttccttccaaggaacaagcatcttttaattcatggtggcagtcaccgtccacatgctcaccattttccatttccattgttaattcctggttcactagaggaggagtctcctaggggcccctttggtggggaagagttttctttcccatggttttcttgaatgacaagctggttttcttcctgaaccagtgtcagaagtcttaaagaaaggccccatctacctgtcaaggtcacacaaaaaaaccacgtctggagatgggagcttgcttttggttttcgaagtggactcttccttctgttgtttcagagctataaagaggggtgctttgtaataatagtgtctgaccggggagaaaactggccccacttccacttttgttaaacagcctttcaaattaaattctctctgggctttccatttccagtgctgccagccaagctgtgggcaccaaatagaaacctacccagcatctcagacacaacgccccaaagtgctgggaaattaatctcttgaagaaggctctgaagttgtgttttctccaagattaagagcagaaggaatcaggctttttataccttcctgcctttgctcaactgttccctctgcctggaaagtttctcctcctcttctccacctgacaaactacttcatccctcagaagcagattaaactctcctccgatgcctctcttaaaaaaaaaaaaattttatgtgggccattttttaagtctttattgaattttttgttacaatactgcttctgttttatgttttggtttcttggctatgagccctgtgggatcttacctccccaaccaggggctgaacctggaccccgtgcattgaatggcaaaatctcaaccactgaactgccagggaagtccctgatgccttcttgaatttaacccacctgagcagccacatttgatctctgcacagtgtcttctgacatgctttattggtttaaaggtgagacttctaggtcacctataagcaagtgtcttagcttgactaccataacccgaaggcgtggtttaaccaccagaagttaattttctcacagttctggaggctggaagtctggatcaggatgccagcgtggtcaagttccactgaggtttcttttcctggcttgtagacagccaccttggagaaggaaatggcaacccactccagttttgttgcctagagaatcccgtggacagaggaggctggtggcctgctgtctgtagggtcgcacaaagtcagacacggctgaagcgccttagcatgcatgcatgcattggagaaggaaatggcaacccactccagtgttcttgcctggagaatcccagggatagaggagcctggtgggctgccgtctgtggggtcgcacagagtcggacacgactgaagtgacttagcagcagcagcagcagccttctctctgtgtcctcccatgagagagactaagcaagctcttctccaaagaacaccagtgccatcatgaagtctccaccctcaagacctcccaaaggctccatctctgaataccatcacattggcagtgagtgctttaacatatgcatttgagggagacaccattcaatccacagcagaacatgtttttgcgcacgtgctcaatcgtgtccaattctttgtgaccacatggcctatagctcgccagtttcctcttgtctatctacagaattttccaggcaaggatactggaataggttgccatttcctactccagaggatcttcctgatccagggatcaaactggcatcgcccaagtctcctgcattacaggcagattgtagatagcagtagataagtgtgttccattttttaaaataaccacaaattccatgttactctttccatcaaggggtagaaaatatctctcctcctgaccctggcttcaccattgggccatctgttttgcccaaacagacacaagcaaatgtgactcagaggactctcaaaaagtatttctgcagcaaggctaaccctctcttactccagggacctttccacaatcatgtgaacgaagttctacatactggggggtttctttgcttcctggttttcacatagccaataatacgttgcctatggggcacagcaaggactgagacttctgttttatgatttgaccatctgatgacctctcttgggggggctgatggaggtttacagtccactgtggggcagggatgagggatgaccaagacttcagctcgtccagttcatctgccaggtagtacacttgacttaataaaggaaatatttcacacttgggaggagattggctcttgggatctggaccggtcagttttcactcacctttgacctttcctgagagggcagagtttaaataacagaaatttatcatctcacaattttggaggctcggagtctgagctgaaggtgtcggcggggttggtgttccctgcgggcagtgagggagggtctgtttcctgcggccccctgggcctctgctggtttgctggccatctgcagttccttgacgcagatgggtcacccgggtccctgccctcatcgtcacatggccttctccctgtgtctccctggatctaaatgtccgctttatataaggacacagtcctattggaacagagcccatcctaatgacctcattcaactcattcaagaccccatctctaagtaaggtcatattctgaggtcctggaggttaggactctcatatatgtctttctctggagagacacaatcaatccataacattttgttttgcatctctttacaactgtcccatagcctctcccttcctttagggcaaaattcacaccccttcccactccttcccacgctacggccttcacacatcctgttctgtcctgcctggagcctctgcccacatcttcttccgctcatagctgattcttctcatcctcagatttggctttgaggtcttctcaagaggccacccccatccttgttccctgcagccctcccacttcctccagagaggctactgcagtgaatttacagcttttaaaaaactgcctgcctgccccactagaatcctacaagaggaagagctacatggcagaagcagtagagagtgacgattaaaggcaaaactctagaggcaaaccaccttggcccatcctggccccatcacccatcagctgtgttatctgggcaagtgtctacagctcttcacacctcagtgtcctcatctgcaaagtgggacaacacagcattctcccgaagacttctgaggcagacgagatgagataagctaaaacacgcaaagctcttgaacactgcccgacactcagagggaggtacacaagggttaaccacgatcattacaggagtcgcacagactgtcgtgcactcggaattcggcccagtgcctggctccacaaatatgtgccgaatgaacaaatctctcataagccagcatgtggctcacatggcttcctattgtttttttaagctttatcaacagcttctaaaaagggcctagtttatagcatccctgtgaatgaggtgtggatcatgggggtctcatccccctagggaatgtttcagggagtcagctaatacagagttgctctgggaaaacctggtttctagaaagagcaaaacatggtccttggtggctgagcaagggtgagaatttattccaccttgaccccccatgttggagaccaaaacaaaggactcagggggctggggtttctggtctacctggacatcccccatgggcctccagagcattgccaggatcaactgaagcccagagtctgtaaagtacataatcacttatcaaaggctttcgtgtacattgcttgacagcatcatgaccaagaatgaggcctgatgagagctttcaagagctttcagttacacatcatcatcttaaaaaaaaagaaaaatgcaattaagtggaagttagcagagaagtgccccactgccccagacacagtcctgccagcagcaagggtggaagagggaggcgagggtccaggcatcctagtctcgggtcatctctgtttcttctgcagtttcttctgaagtttcacctccgcctggatggagccactggacggatgtggacacacacagcaggtggcaatggcccaagtccctttattttaatcccggggccccaaaactaagaaggggagcatctaaaatggtcactaaacgtggattcctttccagggtccagggactcagaagaaggggcaggaacaaagtctgagcttaatactgaccctaggatccttttgcagcctgtgcttttcattttcgtttttaaaagttaatttttatttgactgtagttgctttacaacgttgcgtcagtttctactgtacagcaaaatgaattagctatatgtacacatatatcccctcgtttctggatctccttcccgttcaggtcaccacagtgcattaagcagggtcccctgtgccatactctaggttcccatcagttgtctactttatacatagcatcgcgtggcactagtagtaaagaatccccctcccaacacaggagacgcagcatacccaggttcgatcccagggtgggtaagattctctgaagaagggcatggcagcccactccagtattcttgcctggagaatcccatggacagaggagcctggccggctacagtctatgggggttgcaaagagtcggacgtgactgagcaactgacacacacacccatcaatcatgtgttaagtgtcagtcctgatctcccaatccaccccactccccctttctcccttagtgtccatatacttcattttcctttctacacacaagataaataatcagtctccgtttcagagttcccaggagaggacaagaggccccaggcagttataaggccaggtggtctcctacagctctgacagccacaggctccttccttccttccttccttccttccttccaccagcagttctagaccttgcggagatgcctgttttgttagtcatgggccagaaagggtcccgtttacacaggccaatcttcgtcaccatgacaaccagtgatgacgctgtactgtccagcgccttcgagagcaggaccccaggagcaaactgtcacctcctctccaagctctccttccctttgatcgctgtcacccggcccagtccctatcaccacagttctgtgacacccctgaacccctggtctttcagactacccactgtccatgtggtttgttttgggtatttttttggagggagggggtttgttatttcattttgttttgttttttgtttcacaaactattcctctcaaagctttccatttagcataaataattccttaaatgctgaggaaagagagtgattatagactcagactttcatattcacccattcatacatgtgcacatgcgtgctcagtcactcagtcatgtctgactctttgtaaccccacacaaactgtagactgccaggctcctctgtccatgggattctccaggcaagaagagtggagtgggttgccgtttctttcttcctccaggggatctttccgaccgagggattgaacccgcatctcctgtggctcctgcactggcagacgggttctttactgctgagccacctgggaagccccccttgatacataaataactattaagggcagatgacatgccagatacttaggagggcatgaatggatttcacctatgtattgactctcatccactgaggttggctgcctggaggactgtgttgagaaggattctgaggcccgtctgggcacagcataaaaagagtctgtgagtagcaatcacccagggcacctcaaagaggaagcaccctttgcctctgcttcctactaccactcccctgccccaggggtcccccgtgagtcagctatacaaagcaccctctgcacatggcatcctctgcccacaggtaccctctgcccacaggcaccctctgctcacaggcaccctctgcacacaggcaccctctgcacacggcaccctctgcacacaggcaccctctgcatacggcaccctctgcacacaggcaccctctgcacacaggcaccctctgcacacaggcaccctctgcacacggcaccctctgcacacaggcaccctctgcatacggcaccctctgcatacggcaccctctgcacacaggcaccctctgcatatggcaccctctgcacacaggcaccctctgcacataggcaccctctgcacacggcaccctctgcacacggcaccctctgcacacggcaccctctgctcacaggcaccctctgctcacaggcaccctctgcacacggcaccctctgcacacaggcaccctctgcacacggcaccctctgcacacggcaccctctgctcacaggcaccctctgcacacggcaccctctgcacatggcaccctctgtacatggcacccgctgcacacgggagcattctcacatcctctggagaactaggaggaacctggagctcagcctgaggcttgaagagccctgagggctgagcgcagctccccagcctagaggctgagtggccctgggccacactaaccaccaagccaccctcctgtctatgtgaaaaagggtaatagccggcctcacaggtggtcctgaggattaaaggaaacagcggactcagagcctcagcaacggaggctgacccccactaacatctcaccccctggctgaatgagctgagctgcacttccaaggagagccggccctttcttggaatgttcaggggattctggtgccctcagattctcatttcgtctctggttcctctgaataatctccaaccagactttctacaatcctctcattcactcacattcctctgtttgcttcctctgctggctttagtgctgaccctctggcttctagggcttccctggtggctcagacgctaaagagtctgcctgcaatgtgggagacctgggttcgatccctgggtagagaagatccctgaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggggattcaaaggtacaaacttccggttagaaaataaataagtcacggaggtgtaacgtatagcatagggaatacagtcagtaacacggcagtaactccgtacggtgacagatggttcctagacttcctgtgctggtcaaattcgtaatatatataaatgtcgggatcaccgtgttgtccacctgaaactaacacgatattgtacgccacctacacttcaatgaaagacacagcaactgcaaagcccagcggcagggaagacaaaacagaagacaacttgtgtgaagaaccgtgagcagctggggaggggcggggggagtaggtgaagaggcaggagaggtgggcagaccctcagtggggtgcagggccagggctgaggctgggatttatgctgatgctcatggaaagcagggaaggacacaggcgactcgtgaaaccaaaaatcatcttggcaagtgctcggttgttttcttctcccccctgcaccttgttgaatttaaatttagggcctcttggggcagttggtggaaaaacgacagaaacagcggtggaaagtgagacccccaaagaatcactgtgtatatatcccagagctgataatgcatgctcattaaacactcaaaggttatgtcatcagaaagggaccgtgcagacggtaggagggagacaggtcataagagagccgttttagaagctcagtaactcacatggaccagacatcgattttggggccgtatttcttcctggcaaggagttcgggagcggcgtatgcaggactgccacattgcgtgctgaatgggtcggaatggcccaggatccctgcacagttgctcaaaccaaagtctgcaaagaggaggacaaaaccggctcagatatagaaaaccatggacatgaacaaggagggaggttggggggaggcagcgggaaaggaaacattctctggggctaacacatcatttcgcatccaccaggaaacccagcagctgtgaaccgtaacctctggatatgggtctcaagacagaagaatgtcaggcggtggttccccggccgaactggaaatattttctagcagggcctcacaatcaaatccagtgagagctaaaaagtatgctgaaccaaaacatattttcatcaactcttgggttatgagtcatccaggaaaacaagacaggcttgcttgctttcgaggactaaggcaggaggagaaaacgagccaacagtccctggagtcagcctgctggcttccaagtggccaagggggtaagagccgaaggaagattgatattctctggcgggtgtcggtgtcaccccagatgacacgcgatcccacccgatagagttgacttttttcagctgaatgttttcattgcatgcaagtctcttaaaaaagaatgttcccaatgcatgaggcaacatatggtgatttgaagagagggggaaaaatacacccagtgatttagacaatgccgagtgttggctggggaaaaaaaaaaaaaaaggccagaaaaatagcaatgagaagtagactaaatgacctctagcaatgatccactgcttggatcctgggtgattaaggcagggggcagaagaaagaagcactcagagcatctaaagccacgctgggcccattatgccctctgtgctctgtttaattttgatgttacagatagggcagctgacaggtcattagagagcagttagtgtctggtcctcatctgatatcattcctcaaactttggtgagtgcagatttaagatcatgcctcctcctttgaacttcaacgtaaatatttacggttctggtccccaaagagaagacttggcccatggggctcagacagaaaggggctgtggtccgagacaggctccacgtggagggaaaaaaaaaaacaaaaccttgcactttctcaactggcaggacatacatctaacttcttgttttccttcacgctaacacgtctccacctgcaaagccgtggctcttgtgaaagctatagggaagctcatgaaagaaaaaacccactgggggccgggaaggcagagttgtgagtccatgaagttactcacacaccacgggtcaagatacgccacaaacattcccccctacgatcgttgggttaagctgtacaatgaaagagcatttctaaatagaacctcatccaggcagaaaacacatcaaggctctgaaggtcacccaaactcttcagctgaagcttggaatgaaaagtcagaacccaaatcgggatgggcaaacccaccaggagcgctgcctgttcacacacttgactcttcttttgtttgggagagttttgttttctctctcttaacctctctcctcctgtcttcctctgctccctactcgtccactcccgccttcacaaacaggagaacaaaaggcccctatttgctttcccttcagcccagcttgcaccaggaggcccttttgggggccccacagctctcttggattcgtgttttaggaggagatctctgttctagagactctgagggcccctgctctcaggccctactctgtagtatcactgaagtgggagagctgggaggtgggtcagaagtagaaaaatgattccgagctttcagtcgaatgaccatttaaaattcgctggtggcccagtggttgagacttcaccttccagtagagggggtgtgggctcaatcccgggtcagggatctataatcccacatgccttgtggccaaaactccaaagcataaaacagaaagcaacaccgtccatgggatcacaagagtcagacatgtgttagcgacgaaaccaccaccaccgacagggcaacaaattcaatagagactttaaaaaatggtccacctcaaaaaaaaaaaaaatctcttaaaagaaaaaaaatttcccaaaggaaatttaaggagacaatcaatgcatacaaagcacccactatggtaagatggagagacagcaccatggaataaacatatttactgggccaacattttaagagtaattttataaatagtcatgttagagacccagtctcctgagaacccataaactaaaagtctcacttcctgatctctgagggttccattaactccttcagtttactccctcagctcttgattcggggctacaactaagtgcttgatcttaaaaaagggcagggatggggaggggggaaataagagaccagattcctcacttgctcccaggcaagcttgtgaacactggcgtctggccttgtcttaagcacactttcaaaaagataaatgagccgaggtctgtgggacagagaagataaaatctacattttaagtgacttatgtagacctggccaaaagggtttaatgtaaaatatattgtagagaaataactaatgtgtttcacatgcacaactgtaattattaaaatttcacacatatgcctataattagaattgtgaaactaggggcaagttcacctcccagtaacgtcacacgggtctgcctcaattagatttggtatacacataagccaattatcactcagttttctgagagttatgaaatggatctcaaaaaacacccaaacaaacgctgtcttggaaaactgacatgcaaaatcattttaagttgtggctgttaccctttaagattatactaaactaaaaacatcagactgctttctttttttaaaagggggaaaggatcctaattaaataaaatcttattccagttaattctagttaacttgaaccgtggcttacatggcttaagtaaatttatttatatcagattatttcaaagaaagagaaactgttaagagaaaatggtaatagctataatcaacctttgaataaacaactaggtaattcctttgaaggaaaggttcaaagggctttcaagttgcaagagggcagctgtagagatatttgatccaaattgcctaactcagaagcaagaaaacacctaagacactgggcttgctttgcctcaaacatctcccttcttctcccacctactctgtatgaaaaaaaatgatgaaatgcagattctgctaaacaaaatgcagttcccagttgccctctgggatggcataatgtctctttccattcacacgttcattagggctctttggtttagcgggtcaggagagaacgggcgccaagcgagaagttctaacaaagggacacccagttatcaaagcctcctttgcagctgtttcgggaattctggttcctgacccctggtttctgacatggcccactgtgtccagatgagctacaatgcctgcctgggtaccagttcagaagctgccaagctaagaggcgatgactctgcctaaaatggcttctggtatctaaagggtccccctacccatctcaggagacctgtgggctctaatgtaggtctgccatgtgttcatcttatttgtacaggtctcctctaagagggtttataatgtggccagtgtgtgtgtgtgtgctcatgcgcccaactgtgtgctgtcccacgggctcctctgtcaggggattttccaggcaagaacactggagtgggttgccatttcctcctccaggggatgttcccaacccagggatcgaacctgcatctcctgcattgcggtcagattctttacccctgagctactggggaagcccagccaaggtgtgagctacttgcaaatgtacccacaatttacagagactggttcttccagaatcttctcagcagtggaaaggtctgtgcttttcaacactctcccctctcactgttgattgtctagggctatcacttgaagggaaagaagcaaaaacacacgcaggggcagagagagaggcaaagtgaagggcagaaacagcatgggggtgctgggcgggtaaggggaccgcctggcagtggcctacactgtgctggggtcgccggcctcggcacagacagcgcacaggggagtggggtgcgctcgttcataccataatggacacccagccttcacaccgtctgctctcttacacactctgcagctttagggcaactctgtgactgttccccacacattttccaaagacaactgccaggtcaccctgccagggaacccacaaagaaatctcctttcctccattcctcaccccccacccccaccaggacgtgtctttgtttaatgctgcagacctcggaaaccaggagcaaaaagacatcctgcagacatttcagagtctgccttgtttaaggctgctgtacctggctctcaggacaactcaagtgcaatagtaaaacaatctgatttaaggaggaaaaaaaattatttgatcatccaagaatcttctaagaatacatcctaacacatttgagtcagttctaaggaagtggatgaacctagtggctattatacagagtgaagtaagtcagaaagagaaggatacataccgtatattaatgcatattatgtggaatctagaaagatggtaccgacaatcctacgtgcagggcagcaaaggagacacagatggaaagaacagacttttggactctgggagaaggagagggtgggctgagagaacagcactgaaacatatacattaccagacgtaaaatagataaccagtgcaagtttgatgtgtgacgcggggcacccaaagccagtgctctgtgacaagctggagggattgggtgggggtgagggggttcaagatgcaggggacacctgtatacctatggccaattcctcttgatctgtggcaagaatcacagtattataattatcatccaattaaaataaataaaacccgaatacatcctaaaaatccctcgggtcggggcgggggggggattggtttcctcttaattgttaatgtcctaataacgggtgtatttatcaacacctgtcaatgatgcttaatcacccaggcctggagtgcctggcagcctcttgcctgttattgggttggaagccatctgggatcccaaggaatataactggtcatttgaatgatgtgttttagagagtctggagatggttttcagtatttgccaaacaaaatttccttcttgggtacaaaagctaaaattcacaaagttctgttaatccttctcttttcttctaatagaaagtcttttcaagccctcgaggcagaagaaattacttgcacttggggtgggaaaagaaagaaaggagtaaaagatggggctaacatctgggtggaaacatgatgccctgtgattttgccaagagcaaccacacaggtaaacaaaagtagaatatatctggagaagaacccatgggatgaatttgcttacggacccttagtggtgaatcagttatgattcactccaccctggaatttcctcctgattggcacagacctctaaagcagccctctgtttcactctgtaccattatccggtactacggggctaaagcgaagacatgaaaaggaggaggtaagctgcattccctattatttcagtgcccctacattcactgaaaagtggaataaagcatggccaagctaagagcagcatttttgaaccaaactatgttccccttttcttaagaagctttcaggtgaattcaagtaaaaagaacccctccacttaagttcagctccatctgaattaacagagaagcaaagttagaagaatcctaagaacatgttttatgtttaaattattcaaaaccatgcttagatgttgcaggtaaaaggagatgaactagaagtattgtctggggattagaaatagaccatggtaattttcagtcagaaacaaataactgagaattgacaacacagcacttaaaggataatcttgctttaaaaaaaaaatcatacctatcagcttgatattattgtcttcatctagcagcaagttttctatcttcaagtctctgaaataaacaaaaccatacaacatttcagataagcacttgaaacagtggaataacattttgcttccgaagggaaacgaactgttgagagccactttgaaccaacccataaggcttgctgccaaaactcacacaatcaataagtaaatatttatgaaacgtgatatacgtaattgctgcagagtcaaaaagctaaaggatttcagagaagacagagagcaaggagggcagaaccaatcagtttccaaaagaagtggggccagagttgaaacttagaagttaataaaagcaggagacagtagaagacatcattcaagacaggcactgccagaacagttgagaaaatacaaatgggaccatgttttcatgagttggtgagcaaaaccagccagagtaaggaatattctggcaaatagtttctttcttttttttttctcttaattgaaaatatgattatcagtcctacaaccttcatacttggagcccaagtgaagtgaaagtcactcagtaatgtctgcctctgcgacccccaggactatacattccatggaattctccaggccagagtactggagtgtgtagcctttcccttctccagggggtcttcccaacccagagatcaaacccaggcctcccacattgcaggcggactctgtagcagttgagccaccagggaagcccatgagttatccacaaattggcaagggataataaactattttgcaagcagctattacggtggacagaaaaatagacccccaaaatgtcagggttccaatccttggatatgtaaacattacataaccaaagagaactaagtttgcagatggaatgaagattgctaatcagacgataagtggcttttgatcacggacactgagataactcgggaggtgggagggagacacatgctccaggtcatgccgagtgtgaggggttggtggtacctgtacaagctgactgtcagccccttgaaggtatgaaacattctgccttgcttaccactgtgccccagtacctttgcacattccgtaaccctgtaaataccaatgaatctatattattaaagagatcacttgggattccggaagaaaaaaacgtgggtgaaggtataagccatctatgtcaatgatcatgagcaccttaagttgcaacctgtcagctcagacacaccatgaacattaaatgtgtgagcatatagttagttcccttctatatatacacaaaatgcttttccccattgttttgaaacacagcattcttggtccagcttttatgttcacacttctgaatacagacatagccaaaagagttatttttgtcctcttatctctattgttaggactagaagagtatggtcatgataaacaaaaatggtgactgatagcgagcggttcttggaagtgcagagatgaggggaacagcacttgctagaactgtagaggcccagggagccaaagtgccccatggggacaggggtttacaacttggtctcagcactgccacctcatcccgtcttccaagagtggccagaaatctggattcaatcccagtttttcaacgttggcaacaaattcacaataacaaccacagagcgtgggccaaccttacaggcaagatccagcctacagactaccgattttcaacctccgtttgggaggaagctgagccttcaaaggacatgagacgcccagggagagggcagaaaatgaggcgccaacatgctggcaggaacaaggacattcagagccagctaagaaggaacagtagggcaagtactggcacaggaatgacaaaagggcagcacttcaagatgaaaagttaaggagtggagtgcaggaaaagatgagctcgaaacagtcacctctggatttcaaaactggaatccttgacccttgccttgtagccttaaggctgaatacctgaataagaagggagcatctggggaaggtagatagatggtccccagtccacgtgtgggcttcccaggcggctcactggtaaagaatccgcctgcagtgcacgagactcgagttccatccctgggtgggaagatcccttggagaaggaaatggcaacctactccagcattcttgcctggggaatcccatggacagaagaacctggcgggctacagtccatggggtctcagaagagtcagacacgacttagcaattcaacaacaacaaatccaatgggaagaactgtacacatgcccttcgatttaaataaaaccatacactcaaaaaactgtaccagtctttaaaagatgtcacctatgttcaaatgcagggtaaaccctcccccatcaccaccatataaagtgatcctcctcacttttccaacgggaagactctgcccctcagaaggttttttggaaaatacaaattataatttttagaaatgcaatgaaatgataaaatgactatttacactatttatctatgaagctgcaccatcttatttcagagcatatactatcatcttaacataattactttagaaatattgttcccacgccctcacatcttattgaaacaatttcattcagactcgtggcaggcaagagcaggagtctccagtgtaatgctggagtaggttgccatttccttctcaaagggatcttcccgacccagggatcgaactcgagtctcgtgcactgcaggtggattctttaccagtgagccatctcaattgactggatgtttgagataaagcaccattcaaatctgtatgtgatgtgcttgttggaaatattatcccaagccatttaaataataagagcccatttaaaatctctataagttatccactgagtcaattgattttagagtggtctcacaaactctcaccactgtgagtcatatcccttttagcagctgttattaaagccacgcaaaatgccatcgcctccctttccattggttccctcagacttctagagtttccaaggccatcggtgagtcaggtcaaggttaactagtattttgctgttgaaaataatggagactgtaccctgatactatgagagactttgcaagcattctgtaaggcacttcttccttcctgaaaatgagagactatgtcttacccttatattcaagcatatatggtaattcccggccacttgcacggactcacaaaacaatgtgccagcaacagtccaaactgtgaattctgtgaaaactgattataaagcagcagcactattttagtctaaaagagggccacagtttatttccagcaaaattaaacctctttccctgggaagcatggaagccacacgaaggcattaaaggagaaacttggttcagaacaaatattatgaagaaaaacagcttaaagaggtgaggacaaagaatgcaactgccaagaacaataaaactaagctggataactctggggccacaaaataccaaggaacaaccaaccacagtgattagaagaatgatataaatgaaaggctaaaaataagagaagatacagaggagaaaaaaggcccacttttaaaataggggaaatgtcataaaaccatggtagaaagtataaaaatgtaattattacgctcagtcatgtccaactctttgagacctcatggtctgtagcccaccaggctcctctgtccatggaattctccaggcaagaatactggagtgggttgccatttccttctccaggggatcttcctgacccagggggtgaatctgggtctcctgcactgcaggcagattctttactgtctgagccacaaaggaagccccccaaaataagaggagatgtagaagagaaaaaaacccacttttaaaatagggaaatatcataaaaccaggatggaaagtataaaaatgtaattattaggcaaaaggaggaaaatgaaatcagtttttcttttcacctgttgcatcccctagacacccaccccaacccctaggaaaaatgctcacagcaaagctggttaatggccatttacccataccttttcatcaaggtttctaaaatattccagtgacaaccaatcgaactgcccaaaactttcatgattagttaatggaaagttaggtatatcagtctccacccagatcaatgtatttaatctacccaaatgaagggaatattcaacctcttttggctttatttcacctcctgatttgtctttggaggtttatctacaaagaagaagaagactttccttctggctctagggaaaaaaggctcaaaaataatattttaaaacgtcattttaccctaggatatgaatgtttacagcagctttatgcctaactgtcaaaacttggaagcaaccaagatgtccttcagtaggtgaatggatatactaactggggggcatcccagaccatggaatagtcttcagtcatacgaagaaacaagttatcaggactcccctggtggcccaatgattaagattccaacttccaacacaggggatgtaggtttaattcctggtcagggaactgagaccccatgtgccttgtggcaaaaaaaaaaaaaaaaacaacatgaaacagaagcaatattgtaaccaattcaataaagactttaaaaaatggtccacatcaaaaaaaaaaaaaagtttttttaaagaagaaatgagttaccaagtcatgaaagtcatcggagaaccttgcatgcatgctcagttgctaactcatgtacaactctttgcaaccccaaggactatagcccagcagacttcttcgtccacgggatttaccaagcaagaatactggagtgggctgccatttccttctccagggggtcttcccgacccagagattgaatccaagtcccctgcactggcaggcaggttctttaccactgagccaccagggaagcctggaagacccttggtggtagtttagttgtgtccaactcttgtgatcccatggactgtagcctgccaggctcctctgtccatgggattctccaggcaagaatacaggagtgggtagccatttccttctctagaggatcctcccaacccaggaattgaacttggaaccgtaaatgcatgtttttaagtgaaataaggttgtctgaataaactatgattccaactctatgaccttctgaaaaagactgtagacttaaaaaatgttcacaacttaaaagttgagagttatgttttaatcggcaggaatttttaggacttcaagcccaggaggaaacatatcaaataaccctgaaggaactgctccagggaggtgaggaggagagctaggttatgtagaagtatgtgactacctacaaaggcaggtagtctgaacgtcaaaagattattataaattaaagaaaaccagctgtcccatgttaaggaatttagcaccttgcggtgtatgggaagagcaagagtctggcctcactgaactcactcctttgataagcacttccagtctcgggggggccgggatcctgtattttcacatcttgagggtcctcagggctcactgcagggagtggctgtggtctgatggctactagatggcagctattctttccttcctgagttccctcagggctcactagctcaccatttatgatggctgcaattactgatgtctgcgacatcctttgtttagtgatatggcaggaaatattccatttctcaagagaaaactacagacaaggagaagatcaccagttgcctgaggttgcagaaggagggctagaatgtacaggtagaacacattattttagggcggcaaatttatcctttatggacttccctgcctgcgaatgcaggagactcgggtttgatccctcggtcaggaagatctcctagagaaggaaatggcaacccactccagtattcttgctggataatcccaagaacagaggagcctggtaggctacagcccacagagtcacaaagagccagacatgacttggcgactaaacaacaaacgattctgcacactacagtggtggccagatggcaccacgcatctgcaaaattcatagagggcacagcacgaagaacaccctaatggaccatgcagcctgaagaaaccgaacgtaaactgtgtacattacttaacaataatgtatcaatactgattcagcaattgtagccaatgtcctatactatcacaagatagaatagggaaaacacagggaagggaaatgggaactcttgttctgcatgatttttctgtaaacctaaaactcctttaaaaaattaagtctattaactttttcagtaacacttggatattttccccttcctaagagatcagtactaggaatgctatgcccccctcccgccaagcctcattcaggatgttccctgtggagcatccttaccacctgaagttaattatgagtccattcagcacagcgggccactcagaccctctgcccagctattcaacaatgactctaaagaccatgaacgatctcgtgaggccaaaaattgaaagataacttcttgaataataaaagaaggataaggggatttcctgatggtccagtggttagaactctgcacttgaacaacaggaggcaagggttcaatccctgattggtctactaagatcctgtaagccgtgtggtacagccaaaaaaaaaaaaaattaaaaattagaagggtgaatttattcacaaagttttagtgttagcatattacaatgcaccgtgtgtgtgtgtgtgtgtgtgtgtgtgtgtgtgagccactcagtcatgtccaactctttgcaaccccacggactatagcccaccaggcttctctgtccgaggaattctccaggcaagaacattgtagtgggttgccattcccttctccagaggatcttcccaacccaaggatcaaaccagggtttcccacactgcaggcagattcatatatatatatatatacacacatatactggcaggcctctgtaacccagaaaacctccccatggtgcatgtgaaaagcatggtgtttagctccatcccaagagcgaaatatctgtctgtattcggtgtcaggtctgtgagatgagagggaaggtcctgacagctgaccagtttgcacctgacgataaggcaatgctcagtttcacatttaacagcccgtgatgggatcaaccaccttgcagagaagagagagacgtggagggctcttcctcccgacctgcagtggaacaagttcctctctgtggccagctgactgcaggcggtgtgaatgagttactgaaaacgccagggaaggaaagaaagtggtccctgaatggacaggaactggctttcccttgaccagtagggcttccaagaggactcgggacaagtaagaagcgggacagggcgtgtgtggcggaaccggcgatcaggacagtgctggggggctggggtgggaacgctgtgtcctggcagcaaaggaaagcagtcgatggaggccctttgccccagcaagagggagcacaacccagaggcttctcggcccttctctgatgactgagcagtcccaggagaaatgtccggtggggctcctcatggcatccatcccacaaaccccgcaaccgcagacccagcactgggtccggttggggcgttggggggggtgggtaggcatttttccagagattgagaggaaggcccaaggggagagccgtaatcaccagccctttgttctgggttatttcaaaagcacaagctccaacaggcctgactaacaattaaaggttcgcccacaggctagcaagcatccctccccctccacacccacccacccaaaggctcctttaaaggtatcccgttcaagatggtaatctctaaggtttggagacaggccacgaggaactctgccctcccagacccagggggtggaggggaagaccctgttgccataacaaacaagggggtcctggggcgccctaggggaggggaggtgcagctgctggggagacagggcaagggagtgtgtgtgcacgcaggcttgcaaggggaacacatgctcgtgtatgagagtgcgcgtgtgtgcaagcacacgtctgtgtgtgtacgtttgcctgtgtgcacatgcacaaacatgcttcccaaataccaggatgacagggccttacctcacgaggcagtgaaggtcaggcctctaacgaaccccaggcctaaagaagagagctcgcccgtggggggccactcagggctgagacccaagatgaaagggaggaactgctgctgctgctgctgctgctgctaagtcgcttcagtcatgtccaactctgtgcgaccccatagacggcagcccaccaggcttccccatccctgggattctccaggcaagaacactggagtgggttgccattgccttctccaatgcatgaaagtgaaaagtgaaagtgaagtcgctcagtcatgtccgactcttagcgaccccatggactgcagcccaccaggctcctccgtccatgggattttccaggcaagagtactggagtggggtgccattgccttctctgaaaggggaggaacagaggggcataaagcagaggctgccagggaggggagaggaggtcagagggctgtaggcgggggacaggggagagctggtggaggcctagtgtggaggaggggggtgaacctgggccaggacggcagcctgagagtagggcagacaggctccagaggtccggggcttgcgaatggacctgcggagccgccctggaagagtcacttaaacgctctgagctcctgattctttctttggaaaatggaatcctaagaggggccacctggcagggctgattgacaggcaaggatgacagaaacaggccctcgaagctgcaccagcgctgacagacacaaggtgaggcgccggtgcggcaggggaggcgacgaagctaaaggttctgagacacagtgaaggggagactagaaaacagatttcagataagcgattccctcggtgataagcagacagttgttgctgttcagtcgctcagtcccatccgactcttttcgaccccacggaccgcagcacgccagccctccctgtcctttgctgtcttccggattttgctcaacctcatgtccatcgagttggtgatgccctccaaccatctcatcctctgttgcccaccccccttctcctcctgccctcaatctttcccggcttgggaggcaaatgaaaggtcagatagaaggggcccaagacaggagatggggagcctggatcagactcagagaggactaggtctgggggagaaagttgtgcctgcggagacggccacaagatggatcttagtaatgagctaagaataaagcattcaagaaaagcacataactccccaaggcaacaggcattttgcagtgaacaagagtttttttgtttgtttttttgtatatttttttagttaggttttatcatcaaaagcgctgtattaaaaccaaatgtgggaaacgggaaggtggtttaagagggaggggacatatgtatacctatggctgattcatgttgctgtgtggcagaaaccaacacaatattgtaaagcaattaccctccaattaaaaataaataattttttaaaaaccagatgattttttaatctttgacttctttataagatgagcaatttggttaaatgcaagaataatgtgttaagcatgtaacccgatttatttattcaaaatgaaacctttattgaattcctacaatgctccagaaacaaattctgctcatacaatggaagagctattcattcactacaaagatgtcacccaacaaaatgtgacctggaaactaaataaaatggaagtcaatgaagaaacacccttaaaattccacagagaatatggaatattccagaaagaacatgaattggagaccagaaagcttccatcccagtgctaactctgacactaactgtattcattcaatttcccttcactcatccaacagagtcttactgtgtctgaactgggttgggcgctgggttggtctgtgcaaaagccagacaggaaacaagccagttatcttgtgaagctgaagctgaagctcctccaatactctggccacctgatgcgaagagccaactaattggaaaagaccctgatgctgggaaagactgagggcaggaagagaagagggtggcagaggatgagatggttggatggcctcaccgactcaaaggacatgagtttgagcaagctcctggcattagtgaaggagttagttgtgtccgactctcaaagagtcggacacaacttagcgactgaacaacagcaatcttgtgaaaagtacttggaaaacaaaatagaaggcgctggggagtctatgaccagagaagggactcctgcaggaggtgagcttctgagctgggacctgaaggatgaagacaattcagccgaagatttcaagagcctggtggctcacctggtagagagtcagcctgcaatgcaggagacctgggttcagtccctgggttgggaagatcccctggagatgggaatggctacccactccagtatttttgcctggagaattccatggactgtatagtccatggggtcgcaaagagtcgggcaccaccaagcaacaacacaagcagagaacagctctggggccttgaacgcacaggactcggcctccacacataaaacgaatgaggtgggctcagtggtagttacagcatacatatcctcagtacttcctgagggtctcgagctaagcactttaaggaattgagtcatttaatcctcacaacaaccacatgaagtggataatcccttaccctattgtgtagttccggagagtgaggcacaaaagcctgagagatttgcccagtgcagcttttcagaagtagacccagaacatggatacaagcagtctggcttagaatccacacgctgaccacggtgcaacccaatccacaaacttgtcaggctagagctttgtgaaatcccacattttttatcatgttttctcagtccccattaaacaaaagaaactttgatctatataaccagtgtctccaaatatgtgctcaggccctgggatctccaatagtcccctccccccaagtaaagcagaagtcacccctctctcatccgccttcccctctctcccctctccaaaggaaaccaaaaaggtaaaagaacttcgtaaaaccccatcagcacaggtgggatctgcttcttgtcaggcttacgagaacaaagaagggtcccctctcttgcccggcattcctcagagtgcagaaggccccttcccagccctgatgagtgactggggtcacggctctgggagcagccgtgttgacacacggacgcctggtccctttgatcacgcatctctctcactcccagtcctgcttgtctcttcctgcttagggatggcggtattgtattacccgggtatgttttgtctgtgcagcttgattggactttgttattttgaacaaacagttgaatctcaaatgagcctctcggcatcagcatttctgatgatggatgttaaggtcgacgctttttgtatgatagaaaagtcatcagatgttggtgtgagcccagttgagaaaaagaaaaatgggaaaaaagaaacccttgttagaatttaaacccaaagttatctcaggcagtcctcagagggtgtaatgaagatgtgaggtccacattctaactttgcgtaagtgaacaaccccactgctgcagcagatgacatgaaaggtgtatggcaggtctttttttttttttaataaccttacttatttttggctgtgctgggcctttgttactgtgagagcttttctctggttgtggcgagaggagactactctctagctgtgacacgcggacttctcactgaaggggcttctcttgttggggagcacacctccagggtacctgggcttcagtaactgcggcacggactcagtagttgtggctcatgggctctagagcacaggctcaatagttgcgtttcgagggtttagttgctccgcagcatgtgggatcttcccagatcagggctcaaactgatgtctcctgcattggcaggcagattctttactaccaagccaccagggaagcccaggttcagttttaaatgaagtcctctgccagctaaggaaatctactttacagacgtttggtttccttttttcccttctacttgtaatagttacatgatttttaaagagtcacttcctttaaaagatatttaaatagctctggatcgataattaaatatttagatttaatttcacaggaaatgagggctctgccaggcattaagctgatgatgatatgacgatacagtatcagactcatcaggaactatgctttttaaagcagcctctaacatacatcacctaaagccctttaaatcatataacgtagccaccaaaattcatcctaaatccttttggatgatccaatctgtttgctcagaaatcttcccactagggacaccaggaaatctctgaaatgctatctaaactctcttcctcatttgaaaactctaacctcgaaatatgcgtgtatgttagtccctcagtcgtgttcgactctttgcgactccatggactgtaacccaccaggctcctctctgtccatgggattctccaggcaaaaatactgaagtgggttgccaaggggatcttctgaacccagggatcaaacccaggtctcttacactgcagccagattctttaccatctgagccaccagggaagcccaaccttgaaataatttatgaattctttccacctctgcagcataaaggagacaattctccaccattaaaaaaggctacagtgtattaccagattatggctgctagaagtgagacactcaaaacctttgaaaattcaagacattccagatatagccacccaggaatatattggaaacagtttcctgtgatgtctccaccacctaatcacctgtgcccacgtgcgctgacactcattaaggagatttctagaggagaaaatgaagaactcctccaaaacggcacctgtatttccagccttccctaacttcaaaagatctgagcctttgccactactggctgatgaatatatttccggagaggtagggaacgaaatggaatgccggagatcagagagagaaaaagcgcaccctcgttgctatcaaaacattattaaatgcattcctttgacgttctgacagtaattgcgctgagaaggactggattttgttaaaattactttaaaagggttgttgagaatttcctgcgggagagaccagcaagcagtgcacagccttcgctggctttccctttgttgtcccggaagctccgagccggggcgcatctgatttttgacagcatgaaacccgtgtaataacaccctgagtccctcggaaagctccacccccagttctcttttcctccatgaccagcggagtgggtaacccaagctgattcattcgcgaggtttctgcctttgtcgtcttcatcaccaaaccaggcatcctacgatcatcatgtaccccatcgtggcagagctctgacaccgcaggttacacaagggggttgttaacagccaaaaatagggttattcacttacaatttctgaatgttcccttccttgctgatcaaaactcagaagagttctgatgaatcgtgatttgttaacagtgtgtctgactaaaaatacgttcatggagagattttcttaccttagccaggaaatgatctgcctgaatggggcctggccccaaggctggctcctcccccagtgccccttccccgagccggggactcccccctccccctagttccccccaagcccgggactcccccctcctccaggtcccttcaagcccaggacttccccagtgcccctcccagccgggactcccccctccccnnnnnnnnnnnnnnnnnnnnnnnnnnnnnnnnnnnnnnnnnnnnnnnnnnttccatcagagctcccctacccagcccgggacctccccccctccccccagttcccctccaaggctgggacatcaccctccccccagttccccccaagcccgggcctctgccccatctatgtccccccacccccagcctggggcctccctccagtgtcccccctgtaccagagacttccccacagtgagtcccaatctgattgggacttcccctcagtgtctccctgccccctccaccaagacctccctactgtgtcccagattcaggcacaaggggcagagcatccctggccaagcccattggtacagttaactgaaggaagccactcataaaagaccatgtcttgtttccatttatatgcaagatccagaataggcagatccacagagacagacagaagactagtggttatgaccagggcctggtgggaggggtgggaatggagagtgactgccagtgggtacccggcttctttttgggggtgatggcaatattctagaattaaggcagtgagtatagttgcacaactctgaatatactgaaaatgactgaattgcaccctttaaaatgataactaatgggatgtgagctgtatctcaatacaagatttttaaacatatgtgtgtgtatatctatataattccttgatcttggttttttaaatgagaatcaattaaacatgagccctaatttttctcaacaacccagagtaattatgaattataactccatgaagaagtatgcatttatcgatgaagtcaacactttttcgggaggaaaagaggacactttcatttttttaaattttactatattctattgaccttattttcggagaaggcaatggcaacccactgcagtactcttgcctggaaaatcccatggacggaggagcctggtaggctgcagtccacgaggtcgctaagagtcggacacaactgagccacttcactttcacttctcactttcatgcattggagaaggcaatggcaacccactccagtgttcttgcctggagaatcccagggacgggggagcctggtgggctgccatctatggggtcgaacagagtcggacacgactgaagcgacttagcagcagcactgaccttattttagtctagcactaaaagtcggcccctaacaccaacagcaacactgccaagaattctgtctccattcagtttgcttgcaaagttcctcctcaggagggaacaggctattcaaaaaaaaaaaaaaaagtttgcttttcataattatttgcaaggttagtttgggaacaaggttagttagttatggggaacaagcctcactttcaaaggcaagttcacaattcatgtagtgattcaattccattgaataaaacagctattaagcaactaccatatgcaaagcaaatacagtgaaagcaccatcaagcactgctaaaaaacagtctcatgccatcttaacgttgatgcttctttcaggcacctgagcaagagtttttattgttttggaaataataataacaagagcagccaacacttaaaatgcccctattacataccaaacgcagttccaagttctttccgtataacaactcatttccctttataccaactatgagatgagtatcatgattattcccattttacagaagaagagactgaggttcagagtggttaagtaaccaggctagggtcacataactatttaaaggacagagccaggatggattcagccttgcttgacttgcactgcagcggtgcgtctggcccagagttggtggccagcatcacggcgcggcccttacctgtggaccaccccggcccggtgcaggtgctccaccgcagagatgagctgccggatgtatctacgggcttctgcctcctccagccgcttcttctcgtagattttgtgcatcaggttgcccccagggcacagctccatgaccaggtagtagctgttctccgtctctaagatatcgaggagctgggtgatgttgggatggcggatcatctgctggatctgtccctctcgccgaaggtttttggtaacgtaggtgtctttcttggctcgcttcttgtcaatgaccttgatggccacctaaggagacaccaggaacgcggctgttaccagacactgcaggcgaagtttacccccttgactagccacaaaaccctaggaagacacatcgctccttctccgcaccaggagcaaagtctgatctgaaatagcatccagggagaaaagaaaaatgttacatcagcaaaggccggaagagtcaaccacgaaggaagagaatgtcattcactcaggccagctcgaagaagtctggaaggctcagtgaagagtcagtgtcaaacctggtgttttatcctgcggagaaaacaccaaggtcacctccagccaagacccctcccctcccccaccccacctcgctcagatctcgtaattgctccaggttgggtccccccaggccttcatttctgaaacagccaaatctgcctccatcttcagttctggggtgtgtttagggagctgaggggtgcaatgcccagggatttggtagccctgcccttcctccctacccttctgtgctccacaccgggccctcaggtctggctgcccctggcttccagtggtcacctctttccctctgaatcacgacgcaggtactcttggccccaagtcaggcccaacctgttgctgctccgaagtcacatctccgctgccacctggatgcccctcctgggtcacttcccctacaatcaacacgtcacatgtatagaccctccagctttgcagaaagggaaggaaggaaggaggaggggagggaaaggagaacggaataaggatggagggatgaagggggagagaagacttctgcccaagtctccaccttcctacccttccttcgtcggctattgccaattcacttacccagccttaaaacacaacactgttttgccctcttcttttcttacttatgtcttctctcctctctaaggcaaccagccattgacacttcatcgtctgcttgcgctcactgcctctctctcacttttccttcctctctgtccccacgccaggctgcattcatctgggaccttgcctcccagcgttcagatgccctgagtctgtgtaagactcgagcaacccaaggggcattcttctatgaggctgtcaagccactgggctgcaggacagaaacactggacctttcatttctatttatttcttttttttgtaattatattttgtaactgcttcataatgcattcagtgtacagaagtgtgataccgattaattagtaaacgattaatagatgatagatagacagatgctgggcaaagactgaagacaggagaagagggagccaaggatgagatggttggatggcatcaccaattcaagggacatgaagttgggtgaactccaggagatggttaaggacagggaagcctggcgtgctgcagtccatggggtccaaagagcaggacacgactgagcgactgaacaacaacagacaggcagatacgtgtttgtacaaaggggctcaaatgttcttttcttttcttttttttaacactaatcctctatcctaagtcctcccaggtcctggcaaccaccactcaaattgtaactttttaacgggaggataattgcttcacactgttgtgtcagtttcaaatgttattttcttgacaagtttgtgataaaaatacaagtctggccacccctgctctggactatgacatcaatgtcctgcctcttttccttgatactcaccccggccccttgaattcacactctgccctgccttgatgtccagaactctgatttcttgcttgaagctctttgggggctccctgatgcccatcgggcaaggtccacagcctcagcccagcactgaagcttcttctcccgccactgttcagcccagactccgagctccccagagcaggtctcctcactccctgtgaccacactactctccaccctctttacaccttcaaatcctcagacactaactccagtcccacctttctcccagaaagtctctttaacactcctatcgtatgctcccatcatacctaccacctgcgataccatttagagcaccaatccctccccttaacacagggaccactccccactttgccacattacagtactttataaatgatgagtgaccaacaggttactaacaagaaaatcagtgaaccttttttttaatcattgaagcaaaactagctgaaaatagcttaatctagctataaacagtttatcatttcttctagaacagtctttttttaaaaaaaatttgagatgtaattgacatataacattgtattagttttaggtatgcaacataaatattgggtgtatgtctctattgggaagtgtttaccataataaatcaggttaacatccatcactatagttataaacttgtgtgtatatgagactttttatgatcttcaatattagcagctttgcaaacatacaatatggtattgctaactactggaggaggaaacggccgcccactccagtcttcttgcctggagaatcccatgagctgaggaggctggcgggctacagtccacagggtcacaagagtcagacacaactgagcgactaacacttcctttcactttcattgctaactacagtcaccaggctgcctgttacatccttcggatttatcttacaaccagaagtttgtaccttttgaccaccttcgcccattttaatggagattatcaggcccttaaaccacagatatgaccaagagcgagacaatcagccactagactagataaatcagaacctgcaacatcccagggcgacgtgaggctgatgctatctgcccacagaagtgggctgcagtttggtctaccagttcagtatatacaaagccaagagctttaaaaactgtattcatttgcgacaaaatatatgtatatatgcataacacatgcacatatatataaatacacacacaaatatatatccatcatcttgtgggggcagaaagaggaatgctgaaaagtacaattagattctgtctgctcaactctatgttgcaacgttttaaaaattacaccctttggcagtggaattcttaaaagtactgtgaataaacaacagtctgaaagcccggcagtaatacgatctgcctttcttaacagagcacacaattattaggaggataatttatttagctctttcattgcctggagtaggttatataatggccacccaaagacattaagcccccatgcttagaaccgtgtgaatgtgaccttatttggaaaaagtgaaggatgctgaaatgagattaacctagattatctgggtggcgctaaaggtcaccgcaagtgtccccataaaatagaggcagtgggagatttcacacaaatacacagagaagtccaagtggtgaagcaggcagagatggcagggatggaataatacggccaccagacactgggagaggcaaaggagggatccacctagagccatcggagggagcacagccttgttgacaccttgactttggtccagtgaaattgactttggacttctggcctccacaactgtgatagaataaacttcttttgttttaagttaccaagtttgcggtaacgcattacagcatgtgtgtgcgcgtgctaagtcgcttcagtcatgtccgactctttgtgactctatggactgcagtccaccaggctcccctgtccatgggattctccaggccagaatactggagtgggttgccatgccttcctccaggggatcttcccaacccagggatggaacccacgtctactagagccacctgggaagcctgtgcattacagcagccacaggaaactaacacaccaggggtccactccaccatcatctgacatcttggttcccaagttctactgattctcaaagtccctttgtgaaaaccctgaaccctacggcagccccgcctagagaagctatcctataaaggcccctctctatttttaaacaccttcacttgtaagcattgctaaacttgtaaactctgtattgataatacttctgaagatggaatgacattcttgattacacaaaactgtttaatcaacttcgtctgtaacaactgaaatgggggtggggggatgaatgggaaattaaggaattggcagtgatcaatgatcagcaaagggaggcatctaatttaatttgacagtaatcagagatttataggcactaattctacccaggggaagcccagtgtgatgatgggtctctagctgaaaagataaactgcttcagtcaggacagttttaaacagtaaaattaaatctgcacagacggactgaggacccaagttgatggaccagactagaactcccaacatggtctctgagtttgtgaatgggctgtggggtgggggatgggaggtgttgtcaggggagtttgtgagtttcatcctgagcatatggggaaagaagttttgctgcgaaaggtcaataaaacaaagtctccaactttctgatggcttcaagttgcatagcctcctgaaattttacagaggaatctgctttcaaggattgcccccacatttccaagtaagtagcaaagtctgagaaattactagagagaggtgaacacacaccagtggaccacaggtgaaactgatcattcatcagcttctcattaactaagacaccatacttatcgcagtatggcaactcccaccccatcatcactcccaggctcctgcaaaataaatacataaataaatacctctcagtgcataaaatcagcaaacttttaaatagctaagctcacacaaaagaaaaggaaatatcccaaggcaaaaaaaaaaaaaaaagactagatccaagatgaggcggcagcagctatggtatagagaaacagaagatgcagggaagaaggggtgatggcaaggaaggagatcctcagaaagcaaaggaagaggttggtctgtggggataggaagcccggctccctcccacacggggaaggaggagaaggagaaacacgcttatcctaattcctccggagaggggctagctgcggaaaggcattcatgcctaatgacccctgtgacgtcttaggagaaaaattccaatgtagaattttacttagaatgagggatgcacaaagcgtgtggccccagtctcagcacacacttccacagacccatgggtgtgcaaagatgatgttcacaaagcactcagtaaaatgtctggcacttagtaagagctccttaaaaagatgttcttataatcattactgctttgctttcactgaggccacctgtagagggtgaagagcattcaaaacttagttcagccaagaaaaaaaaaaaagcatcgccttgacctgtcaccttagcatattaaaaaaaaaaaaaaaaagaagcagcagcagcggcttgaatcacatttgagtgtttcgaactctctggaacagagctgcttttaaatccaaaggcagtggtttaatattagtctactctctcatctcctttaaatattgacttcattcagattgcctacataggatcagacttaacaggatttaaaataattcatcccttcatcctggatcacccttcactgcctttaaaattcattcctctgaaatacatcaaggatgggtcacgtatccaatctccaaaatgaaaaggcagatgtaaaatggatcttcatatgacggagaggaaggaaagcactgatcaaagacactagtctttaatatcacagaaacatgcatatatgcttcagccattatacaatgtccaatgtgtttctgaacgttcagccttcccttaatcaaagcacttttattcgtgatgttttaaataatcagaatgcatggagaacaggaggctctgatctgaatgaattttctttttacgtaaaaatgagccaagaacagctttctttccaggacatgttggtttcttaataaatatactaggttaaactcgagtgaatcttttcttctttagcaaactcttattaaggcacctaaaatatagttgacactgttatacacgccaagcgtacgctctgaaagagacatggatcttcaggcctactggtggccataattcagattttttaatagtgatttaggatgaccatctgtcacaggctgaatcgtctccacccttcccacaccacacccccaaattcacagctgaagccctaacccctaatatgactctatttggagagagctatatgcagtaaaaaggttaaacgggccccaaaaggtggggttattgttgctgttcagtcactaagtcactcacgttcaactctttgtgattccatggattacagcacgccaggcttccctgtccttcactgtcccccacagtttgctcaaactcgcatcccgttgagtcagtgataccatccaaccgtctcatcctctgctgcccccttctcctccttccctcaatctttcccagcatcagaatcttttccaatgagtcactctccacatcaggtagccaaagtactggagcttcagctaagggtggggacctgatctaattggactggtgtccatataagaaaaggaagagatgccagagacctctctctctctccacatttgcacgaagaaaggccataagaggccacagcaagaagctggccacctacaaaccaaggagggaagcctcatgagaaagcaatcctacgggcaccttgatctgggactcaggactccataaatgtgagaagataaatgtctgtcacttaatccacccggtctgtgatcttctgctgtggctacccgagcagactcatcgaccacccaagcatcacacaatcctacgagatgcccttaccctgcagaagagcacaactgtaagaaccaagggtgagcgtccatcctccaagggctggggtcaggtctgacagttcctttcctgctgttttccacacactggcaactcagagggtggcagactatggcagccagacatgcagattcccaggctgggcgcctggacttcaaagccggcccctcccgcctggtgccttggaccgcactaagcttcagcttcctcattgttacagaaaacagaggggcgatcaaagtgcctaccttatgcggtggtgagccctgggaacgttcctggaagccctcaataagtgttagggtctgtgtattttgtgtaggaagagtgtgtagaaccagaagccaggaagccccccacctggctcccacccccgccactccctgaggtcctcaccagggtccccagggcgtcctgaccacccagtctgtgaggccactctgcctcctagcctcctgcttttcctcctagcctgatcttgccaaattgccgccgcaggccgcctccctcctcacattagcaatgtactgtccacttcccagatgcctacgagcatccatttaatgaccagtcccaccacctacatcctgcttacacctctttcccaaactttttttttaagttattcactttaaattggaggataattactttacaatattttgccgctttctgccatacatcaacgtgaacccgccataggtagacctctgtgtccccatcccccctcccagatcctgaacgcccctcccatctccctccccaccctatcctcgcggttgtcctaaagcactgcccgggacatctccatgtgaatggtcctctggctccccaaggacttcccaggtggcacagaggtaaagcctgcaagtacaggatactccaggttcaatccctgggtggggaagatcccctgggggaggcaatggcaacccactccagtattcttgcctggaaaatccaaaggacagaggagcccggcagggtacagtccatggggttgcagagtcagacacgactgagtgactgacacacacactggctccccaaacccatggcttccccctactccccctgaagcagttctctccacaggtgtccctgaagcccagccacgcatcctcctccatccatcacacccctagtcccacacgtaattattcaccaggacctccacctctcaaagtctccgcacaccctctcctcccccaccccgctggctgcaccaccatcccctctggaggtctcccacccctgcctggaattccctcccacacagggctctcggtcagagcaactcccaactcccaactcctctctctgacctcagattacaatttttttctctggcccagactggctcaagccaccctgcaattccccagctgtcacacccatcacagacactcttaatggtggggcacaccctccactctcatttccagcaaggcagctgtctgaccttccagcactgtgcttggttcatccagggcaaggacaggaggggaagaaataaaagaaaaaggtcccagccgcctgctacagtggctcatctctatgcctgccatgggtaagctggccacttgaccaacacctcccctccactttctcagcttcaacacaggctgaccaaagccctcccttcgaccatgaaaattacaaaatgtgacgccacctgtgcatgtggtttcagctcgtgtgtgactgtgatgcaaaaacactctttcccactcttaccccctctccaaaagtctccaggtcagagacttccttaaccagcctaattagagctgcaccacgccctccaccctctaccgtccatgacagcaatccacaacccccttactccattctggttttccattggttccattagggctttccttcttcatggcacaaagtgctccctgatttggggattggtcctgctgaacccttctcaccgcttttcaagcctcctcctttttgtagaatagctcaaatggtaaagagcctgcctgcaatgcagacgacccgggttcgatccctgggtcgggaagatcccctggagaaggaaatggcaacccactccaggattcttgcctggagaatcccctggacagaggagcctggcgggctacagtccacggagttgcaaagagtcagacacgactgagtaacttcactttcttctagagcccaatccccaccgtcacttcaaacagagctcactcttccacgccccatgcctggcagtgtcaggaacacagaagaggctcaggcaacgtgtgcagggccactgacacagccaaggcttgtgcaaggtaaggagaggagaagggagtgagggagggaaagggagaaaggatggacagatggatgctccatgcctccccagttaacgcgcgagccttgtgggttcctggacagaaggcagacagcggacacgagatgctcacactagaacagagatcagatgacgcggaacaaacagcagccgtggtgggccctctcagggtgagacagagcacagagagaagttcaggatcgctgccagcctacgggggtggactgtggtcccctgctccactggaggcgcccagccgtcctgctgaagaaagcgctctctcccttcctgagagcctggctgggagaagtcaccaaggagaaggagagctggaaggacagccatgaccagcagtgaagtgtgccatctgggcacctggtgtccatcgcagaaggagcctcctgcttcccccctgtaccccctaagtccctccctcccagtgtctgggctgtgcccctgccaggcacccttccccgctcctcaccttgtctgagccatctgcatcttttccagaatagctactccagaaggacagggtgtgtgtgccaagttgcctctttgcgaccctgtggaccgtataccaccaggctcctctgtccatgggattctccaggcaagaatagtggtagagtgggttgccattcccaacccagggattgaacccatgtctctgacatctcctgcactggcaggtagacagattctttaccactagctccatctgggaagaaagcccccctaaagcaaagaccaaccagacacacccagaatccccgtttctcccagagagtcacagtcctgaaggtgcctggagaatgcatcatgcacctgcctccttctctgaccacatctccctgccgccccctctcagcccctctgctcacccacaggcctccctgtaggtcctctgatgagacaggggtatttccaccccggccacagactctcaccctcacctccaatcttgctgaggtggcaccactcacacaggctccctgacccacctagtaacagccaaaccctcactccggtccccaacatctcatggcaaatagatggggagaaagaggaagcagtgacaggttttattttcttgggatccagaatcactgcagatggtgactgcagccatggacttaagacacttgctccactgaagaaaagctacgacaaacctagacatcgtattaaaaagcagagacatcactttaccaacaaaggtctgtctagtcaaagctatggttttcccagtagtgatgtatggatgtgtgagttggaccataaagaaggctgagcactgaggaattgatgctttccaattgtgccactggagaagactcttgagagtcccttagaccacaaggagatacaaccagtccattctaaaggaaatcaaccctgaatattcattggaaggagtgatgctgaagctgaagttcgaatactttggccatctgatgcaaagagcccacatgttggaaaagaccctaatgctgggaaagattgagggcaggaggggaagtgagcatgagaggatgagaggttggatggcatgtcaatggacatgagtttgagcaaattccaggagttagtgaaggacagggaagcctggcgtgctgcagtccgtggagtcacagagtcaggcacgactgagcgactgaacaacaacaaagcctcactccagtctattcctccccatggtgcacagcacctcttaaaccccacagaactcatcaactgagtgtggagtctgcctgacccgtggtgctgcagaaacagtgctctgcctcctttgctgtcatgctttctgcaaccagaatattctctggttcaaagacaacacccaacaaacatttcttggatgaataaatgaatgattgaatgaatgaatgaaagtacagctggaaggaaaagattctattttaactagaccagaacctgttatggactgaatcgtgtctccctcaaattcttatgttaaagacttaaccccaacgagactactaggattgagttaaaggttaaatgaggacataagggtggggccctaatccaacaggactggtgtccttgtaagaagaggaagagacaccagtcatacaggggacaagccacgcaaggacacagcaagaagacggccatctgcaagttgaggagacaggcctcaggagaaatctaacctgctgacaccttgaccttgggcttctagcctccagaactatgagaagataaacttgtcatttcaaccacctggctgtgctactttgttacggcagcctgagcggaccaatacagaaccttcatgcaagttattagtgataggttggctcgctgtgtagatctcatcttcatcaatgaaatctagatgtatagccatctagacaatgctggatgaagtaaactgagcagacgttagctggaggggatgccccaaaattcaggaagaatcggcatggggctgagggatctgaggctccagcccaagcctgaattcagtgtaaaagggctgaaaactgtggtgattggcacaacccagtaggaagttttgaaaataaattggtttcacgcctttaatgcatcggagtagagcgtgagcctgtgtggaggatactcatttaacagaaagcagaaaatatcttctgctggctgtataattaatttcagcattgctctaattcaaggagaaatgatgctggacagcaaacacacagatcacgctcttttatgggggcccattaattgctgtaatttatgtcacacagcaacacagctctgacccctggcttcctgccagccaccctcctgggactctacactaaaatctgtctttgtggaaatgaggggggaaagcttccttccccagtttaaacaacagagctcattagggctgatcttggtgatgagggcagaacccagggttgggagaccctcccacccccacctcggggagttctgaaaccaccatcaccaggctctccgagccctgactctagctccaactcagaaagcaagtcacatcccgacaccctgcagaaacatcctgcaggtaggaatccagaaactgcttcctgcaaggaggaaaagtgcaaaacagaggatgtctgagagagctgggtagatgggccaggctgcccaagaagggcagtactagtgcagttgttacaattcctataaacccgtctaccgtctacttagttacagtatgcatgcttcctttgtcgtcaaaatgtatttatgatccacaaggataaaaggaagcccaaattccctgcccaattggaattcaccaaaactcagaaatcctaagggaagatgaggtacaaatttaaaaagatgaggtacaaattaaaacaggtaatgctagaatcatttctctggttttggaaaagcatcaaaaagctccagctcagcaacagacgacaagttttttgagagcatgtgtaattcatctttgtattccccacagcgtctggctctgaaagcaccaaatatactacatcaataaattcactgattaaaagattcaatgtccatttgtctcaactaccctttaactctgatcccccagcagccccttcctgctccaattctcttccaactaggcccaactttttcaatttgtttatttttaattgaaggacaattgctttacaatattgtgttgctgtctgcaatacatcaacatgaatcagccaaaggtatgtatataatggggcttcctaggtggcactaggggtaaaaaacccacctgccactgcaggagacataacagaggcgggttcgatccctgggtcaggaagatcccctggaggagggcatggcaacccactccagtatccttgcctggagaatcccatggacagaggagcttgaagggctatagtcggtggagtcacaaagagtccaacaggactgaagcgacttagcaagtgagcaagcatacatataatgaatcagaatgtaacttggggccaatacagaggaaggctcaaattacatcacctagaagcaaatcgatccgtggaatccaaaagataatgggatggttaggcttgactaccctttgtcagccatcactgtcaatgggctgagaacagcaacttcccgctgcccacggaatactctactcagacagcctgcatccaaccctcccatcacagctgctccaagaccacacccgccacactcctcttttgagaaaatcgctcccctccttattgagcccatcattatcactacctacctgaatattcattggaaggactgatactgaagctgaaactccaatactttggccacctgatgcgaagaactgactcattggaaaagcccctgatgctgggaaagattgaaggtgggaggagaaggggacaagagaggatgagatggttggatggcatcaccgactcaatggactcaatttgagtaaacatcgggagttggtgatggacagggaggcctggtgtcctgcagtccatggggtcacaaagagtcggacacgtctgagtgactgaactgaactgaactggctgagcacttgactcccttcctccccccaaaacccatccccatggcaaccagtcacccaatctcatctggaaatttccttcctccctacctccactacccctgacccagtctcctaaggattccctggggttccctcaagtccccaccttcctccttctctacccactgaggtatcccgacttttcccccctcaagtctttattgaatttgttacagtattgcttctgttttatgttttgatttctcggctctgaggcaagggggatcttggctctctgaccaggggtcgaacctgcaccccctgtatcacaagatgactcttaaccactggaccaccagggaagtccccgggttttctttctaaggacggttatgaccatcttctgtgctcagagcgtttaaaagaaactcaactccttgaggagaaattaaaatttgttcatgacctgacagcagcgccccttacctactttttctttttttgaaaaaaaattttgcccagcttgaattctatcaactttcatttggcccgaatgctgtcagtcgaatgaagtcttcatgctttaaatgttttcatataatagtcgtagtgagacacatagtcctgaagatttcatttgttcttcatttatttttatttggataaaagacatctcatatgaaatcaagcattatcaagtacatcatccagtggtatcaagtgcattcacttgttgtgcaaccattgctgctgctaagtcgcttcagtcgtttccgactctgtgcaaccccgtagacggcagcccaccaggctcccccgtccccaggattctccaggcaagagcactggagtgggttgccatttccttctccaacgcatgaaagtgaaaagtgaaagtgaagtcgctcagtcgtgtccgactcttctcgaccccatggactgcagcctaccaggctcctctgtccgtgggattttccaggcaagagtaccaccacccatctccagaattctttccatcttgcagaaccgaagctccttactctttaagcaatagctccccatgacttcctcctctggtaaaatcacctttctttgatttgtcttttttttttttttttttttgagattccatatgagtgagatcaggcaatatctgtgtttctgtgtctggcttattttacttagcatcatgtcctccaagttcatccacgctatcacaaatgtcaggacttccttccttctcatgctcaataatactgcatcacatatgtgtgctgcatttttttaatccgtctgtccacagatatttttttccacgttgtgaatgatccttagcaaactgttttacattcttttcttcatactaagtctctgaaggctgccgtggattttagactcccagcacatctcagctcacaccaggcacatttccagggttcaacaggcagatgtagcaggtggccagggttggacaggcagtcccggttccacggctttgactgagtcacttactctctgagccctggacccagcatagtctacctgagacagagcactcacaaaaaggcctggtgaacgaagaaaggaatgaagagacgcttgtggtcttcagatgcacagtgtggaggagaatgccaatcacacagattcagagtgagaataaaatcaccccttttggagccaaaccaaggttgaggtctagaactgagaaaccccatgcaagaaacttaacttcaataaacctcgaattgttgacccgtcaactggggcgtgatagtggccaggatacaccgcatacaggggttggcatataatgaccgttccctagttgcagttaaaactgagcaaacaatagtgacagcacagtggggaaaggacatgagtgcagtaatcaatcacaccatgattacacgccagggaagcctggcgtgctgcagtccgtgggttcgcagaaacacaacagcaacaatcgcaccacgcttatacggaggggaagaaagggaaaaaggaagccaggaccacagtaaagaggcagggagtaaagtaggaagcaagggagagaggaagggatgaaaggaaagaaggaaggactgcaaggggagaggtggtgtctcatggaaaccttcaagaagagagatgacctgctcaaagtggaaaagttcaccagccccagaaaattggagcgggggggtgcaggggaagatgtggtggttccagaaaaacaaacaataatagttgtgcacccaccaacccaaggaatccctcccagccctcccgcctccagccccgcggacggctgctgccccttcccacgagggcctcagtccgcgtctgctgaccggttcccagcgccacctgcacacaaggctgccttcctctctgcataaatcacgtgttaaatatcagggctggccccagcgcccatgctccttggaaagagaaaaactaggtcttccttccccgctcgtgctctgatttatacgcctccatttatggtgtcagtcggcgtgaaagcagaatttgtgttcctgcaatgacaccataaatcctcccagcttcccctccacttgctgggaatcctgaaagctccgcttccgctgacagcagataaaggctcttagggccagccagaaattcacaagcaggtaacaaaagggctggatgggcggtatgcgcatgtttgcaggcacttgggcgcagggcacgggctgcaagaatagcgcctgggtgagaccagaatgctctaggacttctttttaatacaggctgttctttccatcgtctgaattaacatctcccagtgtattcgtttgcaagggctgccataacaaacaacgtcagatggggcggcttcaacaacagaaatttattttcatccacagaggactggataaagaagatatgctacatatacagtggaatattactcagccataaaaaggaaggaaatagtgtcatttgtagcaacacagatggacctagagattatctaagtgaagtaaatcagaaagacaaataccacatgataagacttaaaagtggaatcttaaaaatgatgcaaatgaacaaactcacagattcagaacacaaacaagcttacccaagggggaaggtgggagagagggataaattaagaactctcttgtcatttttttttttagctgcctttagtgatacacaaagtttaggaaacaccagataactacattctctactccataccatttgtccctttaaagtttagcaaaaaataaagagacagaaaagggatgtgaggatggattcctaacgatttcctgaaacgaatcctggttgaaaattcccaggatttcaatatgtacatgtaaaaatctagtcctctgtggtgaatagtcacaatcatgttagacagagagctgtaattaattgctcagcctgggtggggagcgggggtaggggtgggggcaggggtggggtacgggtagagatggttctaggaaggaactgaattgggttttggctccatcctccttaaagaggtctttaaaactctgtgctgtgctaagtcacttcagctgtgtccaactctttgcgaccctatggactgtagcttgccaacctcctctatccatagaattctccaggcaagaatactggagtgggttgtcatgacctccaccagggcatcttcctgacccagggaccgaacccacaccttctgtatcgcctgcatctcctgcattggcaggtaggttccttaccactagtgccacccgggaagccctaaaactctttcagtaactgtcagatgagaaattcacacctatccccaaagaggttattcttccattggtatcattttgttttcttaaatggtatcaaggtcctaagagtaacattatctaaataagctatccaaaaaaagaagaaaccatttttaatcaatattatgtggagaaggcagtggcaacccactccagtattcttgcctggaaaatctcatggacagaggagccccgtaggctgcagtccctggggtcactgtgagtcggacatgactgagcaccttcgctttcacttttcactttcatgcattacagaaggaaatggcagcccactccagtgttcttgcctggagaatcccagggacagcggagcctggtgggctgccatctatggagtcgcacagagtcagacacgactgaagcaactcagcagcagcagcagcattcatcccattagatacaatctgataattttagaaagacttaacctcaaatatttcttttttctctaaaatcttgctcatcttgtcaaagtattaatacatttttcaaagcacaagccctcctaaaatgtgaccatttaagaagggagtgggagtttagttctgtttctactgatgacaggaggtaaattttactttcaaggagttttgggatttactgagggtgacattgacaatgtggccatgccagactggaatgaaattatcccagttctatccaggacaccattgttcacaattcttttaaaatttagacttttttattcatcatttactcaatggcctgcagcagaggtgaattttttgggcaagagtgaactaatgtggggacgtccctggtggtccagtggttaagaatccactttccactgcaagggacatgggttcaatccctgcttggggaactaagatcccacagcctcaggcacctaagcccaggagccgcagctagcgagccctctcactgcaaggagaaaaaagtccgagtgccgcaaccaagacccagtgcagccagaatcataataataaactaatctgtttggccaagagttaaaattatttttcaacttaaacaattattttccaacgaggtattatctgtacctagcaaacattttttgttattccaatggcagaacagtaactaatgaaacaacgcgaaatatgcacacacagcaacataaatatttatacagtcaagttcaataaaaagagtcatttcaagagaacagacgatcaccgacttcaaaaggatgtttctcacttaaaaagaaagtgatcactaaggaaacacattttaaattctgaggtttttttttgtgggggtggaggtgtgcctgtgatgggagttattactcagtttgatttcctctggtactgggtcttgtactgtgaatttgggtcaagtactagttatctctttcttccattaaaattaatggcactttgttatgtcaaaatcagaatggaaagattttaatagcgtttttcatagaagacaagattcctggttgcaacctcacccctccctctccaccaaaagaaaaaaatagatactttgatcattatcatactttttaaaatggatcagtagtgataataccattatattgaacgtattttttatcattacataaagaaaagattcatagtatgaacagtattaaaaattcatgttgtaattagattgggtctccatggtccagataaatcgatcaatcagtgtagcagctgtctcaataactgaagctacacaaatatttgaactagctggggagccattcgatgatgtaaattgtccagtttagtgtccataagcataagataatgagctatgggcaatcgccatttcttcattaactgcatagtgtggaaacaaattaaaagaccacagccaccaaaccatggaaagttcacactggggctagtcctacgtgttaggcacttgccaagcaagaagctgcaagacgtttcacatgcattgtctcatgcaactcccacagattctactattttccctttttttttggcctcgccacagcatgtgggattttagtttcctgatcagggatcaaacctgggccccctgcagtggaagcacaggtcttagtcacgggactgccagggaagtctctgttttctctttttaccagagtggaaacttggtctatacacagtcccaccggcagcccagctgggacgaggcacagcctgaatttgactctcaacccacagctaacctgcttcttgccatgtggaggggccactggatctgggttgaagcccaagctgtcttacccaatgggttattagatcattataaaacagctaaatcagataactcgatgcaaccaagaaaaatgaaaacaagttatcttaaagcctaaatcctaaatctctacattatgccaccgcctaatgaaacaatcctatgccatctgtcctaacaaacaggaaggggttcgaccacatgcgtgatcagaacctggtgaacagcggaagcagtggtacaggtaggacagtgtaaacagaaaagtgcaagtcgtaagtgtaaacattagctgaacacggacatgactgatgctagaatcttaatgctgacatctctgaagctccctcagacagggccttcccattcctgctgacctctgcctggatccgcaggcctggtgggtccctctggccatgagcctgagcccaccccccacacccgcatgggagaactgcttgcaatgcacccacagccgggtgtataggccagagttatctcccaggggctagagggaagcagaggtttcccaggtggcagtagtggtaaagaacctgcctgtcaatacaggaggtgtaagacacacaggttcaatcccaaggtcaggaagatcccctggaggaggaaatggcaatccactctagtatccttgctttaaaaactccatggacagaggagcctctcgggctacagtccatagaatcacacagaggtggacacgactgaagcaacttagcacataaaggtgagcagagtggatgggaatggtcagccccttctcctcacctccttcatctctcagggtgcctccctccgaattcattgctttacccaagtcaacctagcagacacactccaggctctacaggttcttatgggttgaaatgtgcccccaaaacatttatgtaaatgccagcccctcagtgggcttccctggtggctcagacagtaaagaatccgcctgtgatgtgagagacctaggttcgattcctgggttggggagatcccctggaggaggaaatggcaacccaccccagtattcttgcctggagattccccatgggcagtggagcctggcgggctatggtccatggggtcacaaagagttggacaggactgagctactaagcagcttacccctcagtatcttataatgtaaccgtctttgaaataaagtctcagcggatgtaattaaagatgagatcactgctcgtgtgctaagtcgcttcagtcctatccgactctttgtgacccccatggactgtagcccgccaggctctgtccatgggattctccaggcaagaatactggagtaggttgccattcccttctccaggggatcttcctgacccagggatcgaacccctatctcttaagtctcctgaattagcaggtgggttctttaccactagcaccacctggaaagcccacgatgaggtcactgctggtgctgctaagtcatttcagtcgtgtctgaatccttcccaaccactccacatccggcccaacaggaagttaaaaataaaccactgtaaactggtggccgactctggataaaggcttacttccagagtactgattaactgaggtctcacacagggcttggcagaatcccactgtctgaaggaaacctctggacggtcacaaagcctcagaagggcagccagagcccccacaggaagaccttgagtctcccgagctgccaagtcccgccatgcatgaaacatcaggagaggcacagaggagtctttatgtccagtcactaaaacctggttcttggcttcagaacccagacgagttctggggtcagacggaaaagaatctgcttacaagattctttcttgcaaggagacctgggtttgatccctgggtcaggaagacttcctggagaaggaaatggaaacccactccactattcttgcctgggaaatcccatggacagaggagcctgttgggctacagtccacagggttgcaaagagtcagataggactgaagcaacttagcatccatgcgtggtggtccagtagatacaaatccgcctgccaatgcaggggacacaggttcaatgcctgatccaggaagatcccacattcctcagagcagctaaacccatgaacctcaaccactgagtccaagctctagagtccatgctttgcagtgagagaagccactggcatgcaactacagagtagccgccacaactagagaaatccagcttgcaccaatgaagacacagcacagtcaaaacataaaataaaagaaattaattaaaaatgtattttttaaaaaaagataagttgaaatcttaaccctgaacctcatagtggggccttgctcagaaacagggtcattgcgggtgtaattagttaagacaagatgaggtcctacaggaataggcagggtccctcatccactgtggctcgtgtccttataggaagagaagggacacagggagaacactgtgaaaacagaaagagagatggggtgatgtggctacaagccaagaaataccagagactgctgccaatccaccagaagctggaagaaattgctagtcactcagtcgtgtccaaccctttgcaaatccgacccatcgactgcagcccaccaggctcctctgtccatgggattctccgggcaaaaatactggaatgggtggccattcccttctccaggggatctttccaacccaaggattgaacccagtcttctacattgcaggcaaatcctttaccatctgagccaccggggaagcccagtgaagctgggagaggggcaaggaaaagctcccctccaggtttcacagggagacaggccctgccgacaattgatttcggaatctttaagtctccaggaccattagacaacacaattcctgttgtttgagaccaccctgtttgtggtgcgggcccaggaaacaaatacaaatgtggaaaccgaagatgtgagtagggttagttcatcaggaaatctcagctagccctaaagtcacttcctctgtagcgctaagtacggaatcagcattctcctgggataggcctatcacaacagtggaagagggtgttaactgacaatcactgaaactgcttccactacaacgcacatcggtgtctgtaacattgcaccataaacgagaggaggttcaccaacggtgttggtgaaggctcctaccaaactactgaagcacactgactgcatgctctgaggatatcagaggcttagctttcaaagtcagtctctttgagtatccacagaaagtgccttcccgccaaactttgtgaacccattactttgcacattggtctgactttaatcaccctccacccccacaccctgccctgtcccactccaacccacagcaaagttcaatgctggacctctcccaggggtgacccagagacagaggggtggccgacagaggctggaagaagagagaacctgcaaaatgcatattccgtacacttacttttgcctggtgtgcatgtgtgtgctgagttgcccagttgtgtctgactttttgtgactccatggactgcagctcaccgggctcgtccgtccatgggattgttcaggcaagaatactggagtgggttgccatttcctcctccaggggatcttcccgacccagggatcaaacccaagtctcttgcattgcaggcggattctttaccatctgagccaccaggggagccctgataaaaccatgaaatacaaagtttgtcatgatagtaacgacaaaccagctggggattcatcaagggtcacgtgcgtgaacgtcaaggctaagaaatacaggacccagattcgagctgggggcccctcaggtggacaggcttctgtgggaaggcagagggacaagctaacacagggcacttctcatcccctagtcttatgaagacacctgtcctgctgatcagggcccacccacgagacttcattctattgtaattacctctttaaagtccttatctccaaaaacagctccattctgtggtccgaggggttaggactccaacattggatttgggaaggtggatacgagtgagagtggacacaattcatcccagaacaaaaaccccaagagatgcaaggcttgtgcctctaagtaaggatactcgggatgatagcagcttacaaccacttcgaacaccaaacaccagcctacaagccatttcaggggcagagcacagtgagcaactctactgaaaaggtcgctgatgcccaggcaccaatgaggcatggcccacccagctgtttgtaataaatcaggttactttcctaatgttgaaattttcctctgtcaccctgagatggatgaacctctcagattacacacggagaaatccaacaccatcatgttcctttcccagaaaaaaacaacaacgaaaaccaattctgttctaaggtcttgcttttcattctctccactcgcatataatcgtcactgacccttcattaaatggtcacactatttacccatccaaggtaagtactgtgccgaaagaactgaggtccaatcagcacttggggggaatatttctgcttgaactcctgcagcagggtctataggatcccagttgaacagctgctgcagttcttaacgcacaggaagtctgagccctgggcctctccatcgccttgaatgatgactcaggacacagaggggtcataggtcttgaggctccaccgaagggcatttcccccaagatcttaatgttacatatgccagagcatgtcttctgtctcccagacagtgagtaacacaaacacaactgaatttatttctcacccagatgcttcatcttgcttgtctttcttttatggagtaaagtaacacagtggatgtttccagagaggaaccaggactgattctgcagaattttaattgtggttccttaaaaccctataatgcttcattggtcactcactgaggaaattctctttttttaattttattgatatatagttgatttataagttgtgttaatttctgttgtatagcaaactgattcagtttacgtatattcttttatatatattcttttccatgggacttccctggtagctcagacagtaaagaatccacctacaaggcaggagaccggggttgcatccctgggttgggaagatcccctggagaagggaaaggcaacccatgccaatatttttgcttggagaatcccatggagagagaggagcctgcaggctacagtccatggggtcccaaagagtcagacaggactgagcaactgagcataagcacaagtcttgttcatattcttctccattatgtttatcacaggatgctgaacatacttccctgcgctatacagtaaagtctgtgggaacattttcactgtaataccataagttctggatttgtggttcatggttcagttctgatcctagaatccagtttcctgagggcagatctggttcttgggtctactcacagtgcatttggtgccttagatacacacacacacacacacacacacacacacacacacacaaagacattcactggaggggcaattcgggacagaaacccagaccccacttggcttgcccacccatgtgccctcgaggcaccaggtgccatggagctgcagccactcaaagggggcgcctttttccaactggtctaccatagaagactcctttttctaaacagtctgcccagggcaacacctttttctaaccagcctgtctagacattcatgctttttctaatttgtacaaaagcccatacaagctgccagcggctctgcataatgaaagaaatcaataaatgtttgaatgaaaaaaatacgtgatcatctgcaagagccaagtctaggtaatgctttctttagaaactcactcacaactgggaaatttctccagccatgagcgttctgacctcacagtacacctagcaaatggctttagatgaagagataaatctttaacgaggacattatgaaaatggaaagagttttccatgagtgtagagggaatgactcagaagagggagaagaagccatcagctgttttctcttttttcccttctctatcttcctttcccttccccttggccttgaataacctttcttctaacaaagagatcttagagtatcttcaaaagttgacatttagtactttaaactccaaaattagctttaattcaagaaacattcctgtcccacaggcaacaggaaacaatcaatattctattctcacatcatagaatgactgggagccaaatttagctgaaaaagtagatgaataaagttgcttttgaagaacaggggataagtctggggggcactacaggaactggaaagacagatattttggcaataataatccagtaacaaattctcagtgcaatcctggactctcaagagatcttagatcacaatggaaataatgggaactcctagcaaagggacggttaacaaatataggtccatatctccaaaaccgttcatgtaaaagaaatcagagtccctaaaggaagaaaaatatcctgagtgttgaggagagagttggctaccaaatcaaaagcatggagaatgaagtggcctcatacatttttctaaaccataccaatctggtaacttgtggggaaatcacctgtacactgaccctttcttcaacttttcaagaatgctcagtgtcagaaaggtgacaagaaggtcaaggcagtatggattcaacggtcagaccttctaagcactatgtcaccaatttaagacatgtcaaggaaccaaataatacttagagcagaaaggaaaaccaggaggcagagaagccacaaggcagagagaggaatattccctaggagcctgggaagctgcaggcagagacaggggaggaaagcagaatgtttggaatgcagacatcctggtcccaggagggtgctgcagtctttctgatcctcagggaggtgtcggcagcagagaggagagatgcagcccaagtctttcttcctcaccttccctttatccttaaaataaactccatcttccatgatgaactgagtgcgtgtccattactagttatctaaaagagcccaattaacacaagggttgaatataaatactaaaatctaacagaagagaattaccaactgccttttgttcactaacatattgaacacattttattttcaagctgtgtgctttacacatatatacacattgttgttgtaaaattgctaagtcatgtctgactcttttgtgaccccatggactgtagcctgccaagctcctctgtccataggatttcccaggtgagaatactggagtgggttgccatttcctcctccaggacatctacccgacccagggactgtacctgcatctcattgaacttgtgtctcctgcactgcaggcagattctttacagctgagtcaccagggaagcctaccacatatacataaaatacgcatgtatgtatatattatgtaattgatatgcattttatatatacacatatatttaatcaaatttcccttgaattctcatgagatattatcaccagtttacaaacacaaaaattggaatttagagtatttaaaaaccttgcacaagatcacgcagatactaggtagcaccagaaaagccataggaacccaaggctttcagtctgtaagcctgagctttaatacatgaccccattgtcatgcaacaggttagaaaattcagtcaaaaatccctatccaacacaaagatttttctgcagacaacaatgaaacattggcaagcttcactgataatttataaggtaaaaccaacaacaaaccctctcatttactttagcataaaaaataagacaaaaactgaagaaaaaagactaattggcttaactagacaaaatataaaatttttctgtactcctctccccaaaaaaggagtcataaagtgaatcaaaagccaaatgccaattgggagaaaacatctgcagcataacagataaaaaaaaagctattatctttaatatgtaaaaagtttgtgcaaatcaataagacaaacaggaggaacctggggataaatcattaacaatagttaataaaagaggaaacacactttcaatcaaatacacaaattatgatgctgctgctgctaagttgattcagtcgtgtccgactctgtgcgaccccatagacggcagcccaccaggctcccccatccctgggattctccaggcaagaacactggagtgggttgccatttccttctccaacaaattatgataaaccttactaattatcaaaacatactttttaatgtatgcatatacacacatatgcatgtgtatatatatgtatacatctatatcacatgtaaccagcccaaacacctaaacccagtgattatccctgggtagtataattacagatgacttttcctgtcttctttgtgtttctgtttattttccacaaggaactgggggtggggatcatatttaaataatcagatttaaaaattataatttttaaggtatctaaaacagaagtagagtatataatgaaatatgttcagtcaaatgtggtagcaaatagtaatgtaagtggcaatgcaagaacaaaatatcaatccatggcagttaacaaatattagccttggatttattttgattaactaaaaacctcaaatagtctagaatgtacctgtgactagactagcttaaagaattctaaaacgtgagctacttagtccaaagtactttaaaaaaatattttagagatatttatagttaatcataggaaaacagacttatattagatgatttagatatattttttaaataaatataccctgttggaatctgtaggacattattctaagtctgattattggaaagaaactatctgtcacgctacgagctctcaggcactttaatttaatggcctctatgataaaagctcattttgatctgggaaaaggcatctcagggtaacaaatcgggtgggagtgccgtagccacaaagcaccttccctccaaagggaaattcaagtttcattatgtcaaattggccttgaaattacaactgccgctcacaaatgttagtttttaatagaataaaatgtcatcctgtgggactgacactttacaaacctgaagaagtgttttcaagttttttattggtattgtaagtgtaaacgttcaactgagaactgagtcatcgactagtttctctaattaaatttttaaccgggaataaagaatgcacttcaaaagctcgactgctacttcagagctgcagtaattccaatgaaagaccagattactaagtggtaacactcatctgtagccatttggtttcactaaagtagggctcagataacgtgctagaatactcggatcccagactttacagccactttccctaaacctgcattttcattcagcacttcctccttccatttgcctccagcgtcccttcagtctggaggaggacagactgagggcttagaaaagttagtctagctccgcccatctgcataataagcaaggcaaaggtactgggtattttctttgttttcaataaataatctgtgttcattcttgaaggggggtggtctaccaaggaggctattagcgaatgtttagtgagccacataagacatgtacctgcagcttcatcatttaattcaaaatcctcatacacaattttctgcctccagtgcaaaggaaaggtactaaaaataagactgaatggtaaccagagctactcaaagtgggtaccagtcctcatcacttccttcactaagaaagtctgccacccaaaagttatgtgtgttgatatttagtttagtactatgatttttatttaatagcacacacacatcaggctcaagttcttcatctcacagtgaacttgtaacagatggcagaccaggacctctacccacactcgggagacctggagtgcactgtgaacctagcatattggagctctcagttcagttcagttgttcagttgcgactgcgtggactgcagcacaccaggcttccctgtccatcaccaactcctggagcttgctcaaactcacatccatcgagtcagtgatgccatccaaccatctcatcccctgttgtccccttcctaggggtggaaaaagccctctcaccacccaggaccacacatggaggtcatcatccacaacaagcaacccagttaaccccagggctttaggctgtggttcattcatggctggttcatgacctgattcattgctctttaatacttttatttgagggaacttccctgatggtccagtggttaagaattcaccttccagtgcaggggacgtgaattcaatccctggtcagggaactaacatcccacatgtggcagagcaaccaagccatgtgccacaaccagagatcccacgtgccgatactactgagccccaagctctggagcctccatgccacaactacagaggagctgcagtgaacaccccttatgccacgactaagacccaacgcagccaagtaagtaaatattttttaaatacttctttttgaaaacccttagcaggattaccaacattgatgagatttcttcattttgccatttcctgaggagtttgtcaaaatgcaagactttggaagcccttgggcaccccgggtagctggtcaacctaaggctgcaaaattgggacaacaatacctactacagaaggccattgtaagggataaattctattccacagcaaagtatctagggtgtggcctagcagacagtatgtgatccataaatgttaatgattactatcgttatcagtattacatccttgtggtcaaagcagagagcaagcactcaatcctttcctgtagacttttggtgattcagaaggtcacaaaatcctgctttgctccaggtagataaagaatcaatgggattctgaactttaccccatcatctggaacagaggtagcaagcctcctcttgggtagctgcatcttccacctcctctgatcctgagcaccatgctccatgcccggagagcatccgtcactgctgttcgccctcgccatgcgcttgcgcagagctctggcaaagagtaggtcacgacgaagagaggagcttcctggaagaagagtatctgagccggacaccttaccagaaagccgagagaccggatgtaagatgacagaaactcagtaggagattaaaatggcagagctacaacatggccagttattagagaaatgcaaatcagaaccacaatgaggtgtcacctcacaccggagtggccatcattaaaaagtctgcaaataacaaatggtggagagagtgtagagaaaggggaaccctccgacactgttggtgggaatgtgaattggggcagccactatggagaaccatatggaggttccttaaaaaactaaacacagagctaccacatgatccagcgatcccactcctgggcatatagacaaaaccataactcaaaaagatgcatgcaccctcttgttcacagaagcgctgttcacaatagccgagacgtggcaacaacctaaatgtgcatcaatagatgaaagaataaacacgtggcacagggacttccctggtggcccaggggttaggacttgggccccttcactgccacagccccaggctcaatccctggtcaaggaactaagatctcataagccacaaggtacacaccccccaaaaaaaatatatatatgagatgtgatatatgtacagtggaatactactcagccataaaacaggaatgaaataatgccatctgcagcaacattgaaacaaataagagattaccataccaccatgtgatatcattcatgtatatggggaatatttatatatgatatgtgatatgccagatctaaactacagtacaaatgagccaatccatgaaacagacaccaaatcacagacacagagagcagactagtggctgccaagggggaggaggttaggggaggcatggagtgggaggtcagagtcagcagatgtaagaatggatatatatagaatggatatatatatttttatatatagaatggataaacaaggccctactgtacagcacatggaactatcttcaataccctatgataaaccataatttaaaagaagataaaaaggaacgcatatatatatgaaaaagtatatatatatatatgaaagtaaaaagttaaagtgaagtcgctcagtcatatccaactctttgggaccgcatggactatagcctgtcaggttcctccgtccatgggattctccaggcaagaatactggagtgggttgccatttccttcgccaggggatcttcccgacccagggatcgaacctgggtctccagcactgcaggcagactctttaccgtctgcgctaccagggaatcatatatataaatatatatgccaaacattctgttgtacagcaaaaattaacacaacattgtaaatcaactatacttcattaaaaaaaaaatgacagaaaaactcaaggaaagggatgagaacaaatcaaacggctcagagaacaggcaagagaagtaagcaggtttgctaaatgttttggcagcaagctggccaagagactgataaacttataaaaaaaaaaaaaaatgtgtagtcaaagagacagaatccaaagctccatatatctccatgggagacatccaaagaaatgtatgtttgcaaatagcagcgttgtccatctgttgtggtgttggtacattttctcagcaaagagctgagggtcctttaacattcctatgatactgcagaatatttttctgcctccggtaggtccctctaatgcctaggtggcttccttaatgagtccccgaagaaggcacagctgttctgggtctggaatgtttcccaaagagctctagctggaccacctgtcccatctacccaccgctcacatgggcacaaccaggaaaggccagcgagtgagagagacagggctttcaaaccattcccggccaactagaacatcactgccatccagaaggtcatccccatgtcctagggagaccaaagcattcttcaatccattcagaaaacattcactgagcatcctttctctaccaggtactattctagccaccaggcatacagcagtgctcccttcctcttggggcttccaggctagtggggagacaaataataaacacatgagcccgtaaatacataccatgggatcaggtgatgttatgagttggagggagtccgcccccaattcatcagtgtaagtcctgtctcagtctgtccaggctgctacaacacgtaccagaggctagatggcttataaatagcagaaatttatttctcccaattctgaaggctgggaagtccaagatccaggcttagatttggtatctggtcagagttctctccctggttcatcgactgacatctactcaccgtgtcttcaagtggcagaacgggcaaaagagctttctggggtctcgcttttttctctttaagggtatgtgtttggagtataattgccttacagcgttctgttagattctgctgtacaacgaggcaaaccagctatctgtatacatataccccttccctcctgggcctcccatctcacccatctaggtcatcacagggcactgagctgagttccccgtgctactggggtctcctctttaagaccacaaatcccactcatgagggctctgctttcatgcctaatcacctcccaaagcccccacctcctaataccatcacctcagggatgaggttttaacctatgaactctgaggggacacattcagactaacccccaggacctgagaacgtgaccttatttggcaacgatgatcttgccagaggtcattacgtgaggttatcaggacggaccctgatccaatatgactgacatcctcgtagaaaggggaaatgcagatgacacacacagagggcaacgacgtgaagggacacagcaggaagacagccgtccacagaccaaggagaggggcctggagcagacccagccctgacctgggctctggcctccagaaccgtgcggcagtaagtctgctatttaaccgcctagtgtgtggtacttagtccaggggctctagcaactaacacaggtgatgggatgcactttgaggaaaaacagagcaaggtgagggggcagagagcaacagggaatggggacaatacagagggtcatcagagagagcccatgctgacccccagggtcccaaacaggcctgggtgttcactccaccaggaccagccctcaaggggcttcctgggtggacaaaacagcccctaaaggccccaggcatacacctgtgcttacacctggctcagtgcattttatgtccaagttaaacagcagcttttggtccttaaaaggatttcacttctcccaatgtccctctttttctttcttctcatccgcccaccacacactctatccatcctcttttccaggaagaaataacaggacacgattcagagttgcccgagcaagagtcaagctctcccaaagacccgtctacactctatcacatcctttccctgggaccaggcatggcaggggcaggaaggaagaaatcaggcatgtcaagccaaggtcatagtctcaactgtacacctgcctcacctgagtgtaatctgcaactcaactcaattagcagaggtgctaacacaccacagtgacccaaatcctcatcccaacacacaaacctccattcagacagcactgcggacagggaggagcaacaaagcagtagctcggtaaataattccttttagaatctgatgaagttatggatccttgtcccagaaatataattatacatgtacaatttacagggatccacagaacttcaaagattgaaagtgggaggagaaggggatgacagaggatgaggtggttggatggcatcaccaactcaatgagtttgagtaagctccaagagttagcgatggacagggaggcctggcgtgctgcagtccatggggtcgcaaagactgagtgactgaactgaactgaacagaacctcaaagctcagctatggtcccttgctagttagtggaatccagggaaccactgcgagaactaccaagaaactaagacaaagaggaaacagggagcaagcaagatgggtcaggcttcaaaatacatcaaaaagaggattcaaaatacatgaaagaggactgattgccttaatacatagaagtgcttataaatcaggaagagaaagaccaacaacccaagggaaaatggtgaatggtcacgaacaatgaacagagatgaaatgcaaattgttgttggacatatgaaatatgttcaactcacaaatatgataaactacacatagtacaagatattaagtttaaccaactagattggcaaagatcaaaaagtctgacagtatcttatactgataaaaatctggagagatgtccccacaccaggttgatgagagtataaactaggacaacttccttggcaggcaatttggcaagactcatcaacagtttaaacagtcatatccttggggattccctggcagtccagtggttaggactcagtgggcactgtcattaccagggccagggtttgatccctggtcggggaactaaaaccctgaaagccacacagtgcggccaaaaaaaaagaaaatcagacataccctttcacctagaactaggaatttaaacctcagatatacttgaacatttacaagatgatacataggcacagatatgtactacaccacaatttggagatacagcaagtcccctacatacgaaccttcaagctgtgaactttcaaagatgcaactgggcaaccacacatccaatcacgcaagtaagttcacgtgtctggtgtacattgtcacgcgcctgcatcctctacaaatggttgtgcttttgtgtacttcactgtacagcactgtatagagtccagtcgctcagtatctttatttcaagctcagagcctctgccatcaactggagtgacactgcagcttgcccttcacctcctattgctaacaatccttccgctctaccatctcccacctctagtcagtaacgcttcttgcctgttcacgagacgccatcccgtgcatgtcagctgtggtactgtgctacacttttcaaggcactgtgagactaaaaaggttttctttacttttgtgtttgtttttatgtattctttgtgtgaaaagtattatacacctattacagcacagtactctataactgattgcactagttggctacctaggctaactttgttggatttccaaacaaactggacttactctcagaatgtgctctcagaacagaactcaattcatatgtaggggatttactgtaacaaaaaaatcgtatgcaacctaaatgcccattctttaattgtgcttaattcgttaactaatgtccattgacttcctcatcaaggaatggctaaataaatatggtacctccatgtactgaatgggcttccatggtggcatagtggtaaagaatccttctgccagtgcaggagatgcagttttgatccctggtctgggaagatcccctggggaaggaaatggctacccactccagtattcttgcctggaaaaacccatggacagaagagcctggcgggctattgtccatggggttgaaaaaaatcggacacggcttagcaaccgaacaacaacagcatgtactaaataccacgcagtaattaaaaagagtaagacaattctttagtaaatttggggaaaggatgttcgagacatactgctaagtgaaaaaagcaacacactgaacagcaagtatggtgtaaaaatatctcttcctatatctatccatttacaaatgtatgcgtatagaatatcaaatgtatgcacacttggatgcagatggagtaagtgtggaaggagacacaggaagccagaagcgggattgcctccggggagaggaacccaacaaacacccaggcacccaggtagaggcagaattacctctcgctgcaccctctctggaaacctttccatttaagaccacgtgtctgtatcacccattccagactttaaccaaatgactcttaaaacataaacacatacaagtgattaaaaaccaaaaaggattcagtaagtagaaaccgcatagttagggagggcagagaaggcaatggcaccccactccagtactcttgcctggaaaatcccatggacggaggagcttggtgggctgcagtccatggggtcgctaagagtcggacacaactgaacgacttcactttcacttttcactttcatgcattggagaaggaaatggcaacccactccagtgttcttgcctgaagaatcccaggaacgggggagcctggtgggctgccgtctatggggtcgcacagagtcagacacaactgaagcgacttagcagcagcagcagctagggagggcagagccagttcagtggaggtggtaacaggatgttaggagatggcgctcacctagcaacccttctgtcacccaaatgtcccaaaccaggactcagagaactatccagttccccacaactcaggagtgatcaaaagggagggtctctcccactgtctcttgattagacccactggcggacaagttagcccaactctgtggccatgacatcctcaagagaaaatacatagaatgtataactgtatctcaaaagcacccacaaacacaacagagagccctgggcatcctagtgaaaagaaacatgatgccggaatattcccacgatgatgctcggtgttgggaactagcctctgtgagctgttccctcattccagaggaggctagctccacactaggtgggcaaggtgacgcagggagccccccactccgtttatggaactggcctggattcagatcaagaccctgaactctggcccgtctcccacaggaaaccgtggacacctggccccgctgcctcgcttccccttctgggccaagaacttcctccgcagctgctgaactctgctgcgagctcgccccagaaactgcccttggcgagtgtccaaggccacgcccctctccagggccgctcccagccaatgatcttccagggcccttccccccaacccggacccctccctagatataaagatataaggacctaaagcctccagtttggacatctcagctcctggagaacagcatggcgtgggtggaggacttcagctggggctgcatcagggtccaaggctgcctgacttctccccccgcctcccctcacctctcctcctctcacagtgctgatatacaccaagcccacaagaccacactccttccttcccaaggtctgcttcccaggaagtcacctacaatccagtcctcatcatctaagaagctgttgcgggttgaactgtgccccgcagagagatgcgtaggtcccacccacccttggcacctgtgaatatggccttatgagaaatgggatctttgcagatgtcatcaaggcgagctcctactagtttacggtggaccctaaatccatttggactggcttcccttgtggctcagacagtaaagaatctgcctgcaatgtggtccatgaggtcgcaaagagttggatacaactgagtgactgaactgaactgcaatgccgaagacctgggttcaacccctaggtccagaagatgccctggagaaggaaatggctacccactccagtattcttgcctggagaatcccatggacagaggagcctggcaggggcttgcaaagagtcagacgcaactgagtgactgacacttttactacttttctaaatcgcatggctggtgtccttataaggagagggagatttggagacagagaagactcacaggggatagaaggacttgtgaggacagaggcagacgctggggtgctgcagccccaagcccagacacgccagggatggttggcaagtaccagaacctcccctaaagctttcagaggttcacccacaccttgattttggactctgggcttccagaagtctaagaaaataaaattttgttgttttaagtcccccagtttgtggtcattttttaaaagaaacttcttattttgtattgcaaaaggagacaggggtggcagaggaagagatggttggacagcatcactgactcaatggacatgagtgtgagcaaactccaggagatggcggaagacagagcagcctggcgtgctacagtccatgtccaaagagttggacgtgacttagcaactgagcaccagtagccagttaacaacattctgatagcttcaggtgcacagcagagccactcagccatatatacacatctatccattctcccccaaactcccctcccctttcggtcatttgttagggcatccaatgcggaaaacgcaggagacgtgggttagatccctggatcgggaagatcccctggaggagggcatggcaacccactccagtattcatgcctggagaatcccacggacagagcagtctggtgcgctacagtccacagtgtcgcaaagagttgggacacgactcaaacaacttagcatgtgcacaccctgacaatagagaagagaaggtcagaggaaaaaatccacccaggccaacctcctcatggtcaacgcaggtaaggatacccgagaggtggttcttatttgctcagggtcacttcaagcatctaatgagaaaatgcatggaagactctggatacgccacaaagcgctctaccgctgagctggcattcaggagaaaggaggggcgacagctctctctgcctttgtagaagcctccgcctccttgggtaccgttcaggccccgtggttcacccctctcctgccggtcatcctaccagccagcagcactgcatcagagaacgtgaaattccattcagatcagcacttgaaagcggccagggcccaggctgagtgggggaagcggtttcgccagtttgctaaaaataaggctcagggattatctataggtttcaattagccaagagagcaagcaggttgctcggttaccatgaataatcgagatggggtgtatagcccgagataaatgatacctcttgcccagcccactttttcacagaggacacccagcctgccccctctcagggcagacaatgggggccactccccacacctcctgggaggagaaccccgggcatggatgaccaccatgtggccctggaacaacctccagtgtgcacaccgctgtagttgagcccagcctgtagcaatgactccacacacccacagagaaaatttcaggttgtgctcctcttcacgggcatggttcagcactgttgtgctgactcaaagcgccctttgaagtccttgggacttgaggatcaatgaacactgagaagcgagccctacgtgccaatttccatcattcacaaggacttcaaaaagatgaggcagggcaggaagttcaaaaaagactgtgccttcgaactgcagcatgcaatctccgaaattataggcacagccttatcacactcgactcttggagcaggtgctttttgcccgatgcctctcacttgccaagaaatccctgctgagggttaataggaatatccagttccttaagcatttcttgtgcctcagagctattacccctaaatttctagcacttaaaaaaaaaaaaactacaggatttagcacctgtttgtctccgaaatacttgctaaaaacagatctgccaaaaggccacctctaaaattagtcatatttcctgctctgaaaaacatagtaaattctatttttagtaactccttcactccaggtacctggagctattatgctcgggcataattattggcaacttcctaagcaggcaacccttatttttagccccaaaatagctccaatgaaaatgattaacaggctttaaaaaaaaaactaaggcttagaacaaggtattaagcatcttaaccaatcattttacgtacctaacttcacagagacttaatcaccaaaaaaagtaattgcggcaataactattttccccttcctgcagttttgcctgtcggtgaaaacagctctatacctgaaggcacctaggctcatccctgtcagcctctccaactacactttcttcatgttttaaatgtgataaccttgggccttcctggtggcccagcggttaaggatccacctgccaatgcaggggacccgggttcaatccctggtccgggaagatcctgcaagtcgctaggcaactgagccagtgaggcagaactactgagcccatgctctagagcccatgtcacactactgcactcatgtgctgtgacgactgacgtctgtgcaccctcgaccccgtgctctgcaacaagagaagccacggcaatgagaagtccgtgcgccgcaacaaagagcagccctgcagcaacaaagacccagtgcagccatagatagagaaacaaatacttttgaaaaattaagtaccaaaacctatcaagtgccagagactctgcattgcccaggtattggggaccagcattagaggctgtgagcacacctcccttctgggactttacaagttatcacttcatactcccgcacggcaacttcattctttgtctcaaagccactgagaatccttttcaaagtcttatcctgtcatcatttttttttcctcgtctaatcatcaacttagtcaaagacaagactcagaatgtgctggttaaagagtttcacatgatctagtgaatgatttatttttaaagccacgttaaggcaggctgtaccacctgaaagctcctagaggacgaagtgaggccctgcccaaagccgtcggtttttttcaagcagtaaaagggccaaccggattcaaatgactctcaaacaactttggaaagaggtatgcaaaagaaaagccagggccgggggagagggggcggggatactgtcctgcaggcagtgatgggaaaaggtgcctcttgataagataggattggatgaaagtcagggaaaagtgtctcgtttttcaacctgattcagagagtaattcgcagcatgccatggagcatggcacccaaagctttttggaaacatgcacaagtcaaaatgcaacgcacaccaagtgccctaaaccagtgatactctggattttggcataaatcacccaaaataacgtgcccagtttgagaccgcaactgcgggcatggggcgcctcctcttcttccttttctccacccacctttgcagatttttcctgaactgattcctcaggacaggttgccctggatccttacactctgggggtgctgtggggggcaggggcggggcagaatgcatcgattcccccagacacacatcttagtatagcattcatgacttcgtgtgtggtctgtggtctgtgtcctctcaaaaagaaaggaaaaaagaaaagtgaagagctttctccgaaaagtacgcacctccccaaagggggaattattgagaggagcgggcctcctgggacactcacatcacccactctggggacatttcatttcccttcctccaagtcctgtcacctccagttgtcccctggcttggctctcaggagtaaccactttctgggtaaaatctctattaataggtcaccttttaaagagacgtggaaggctgcaaattgtgtgaggttgatttcacctttgttttgttcttagtaagacaggatccagcatatgagtggggctggggactcatcaactcagcagtccttcctagttagagtcatctacacacacacacacacacacacacacacacacacacacaaggtaaagtcatacacacacacacacacacacacacattttaatctctgcaatctgccaaaaccccaaatctattagttaagcattaaggcattattaggagaaggcaatggcaactcactccagtactcttgcctggaaaatcccatggacggaggggcctggtaggctgcagtccatggggtctcgaagagttggacacaactgagcgacttcactttaacttttcactttcatgcattggagaaggaaatggcaaccgactccagtgttcttgcctggagaatcccagggacggcagagcctggtgggctgccgtctatggggtcgcacagagtttcacacgactaaagcgacttagcagcatcagcagcaaggcgttattggatctgtgagatacaagctatgaatgacacccatcgtttctttaaagctggccattaagtgaactaaaatccagacttctcaggaggcttgcagtcccggagcccccgattctcccggctgaagtagggcacacatcagaaatatctcccactgtcctccaccactctaagatccaccttccttaactagattcaatcagttagtccagcgcaataattttacgtccaattaattggtcctccccttgcggagaggaagtgaaatgcagcgtttgaaaaagacaagatgagaaaaacgggcgtgagcccctaaggggtgcgaggggtggggggggggggggggcggaatcctcactggactccatccgggcaggaattcctcgcattccagagtgcctggggcccagccctgagctccagaaccgcagcacccggctagggactgagttcggagtgcaaccccgggccgttcagccaaggcacacagcctgatgttagggagggaaagggcagcggcgaggagccgagccacaggagagaataaggcagcccgaacaagctaagcggccgggcagggggagcgcgcgcgcgcctaaacgttgcccattatgctgtgagcagagcacctcgtctctttctgctaagtttcaaagaggaaatggacgtaaccagactgattgctctacatttcgagtgaaaagaaagttctattaccagtgcctggcactcggaagtgagcgctctgtaattagcgagccggatccgcgggcatccccgccttctcccagacgcgatgggttaagttcccagcccactgcgaacccaggagtaagcggcactgccgctcactttggactagaaggaggtttggaggggttttcttcttcttcttgaaagagcccctccattcagtgagttcctctcccaaacactcccccttgtgcatggaaattgaagccagaggcactttgaaaagtactcactgctaaccccacttacccgaaacaaaggggcacaccacctcgagagactgtaggaagggaacaagtgacaagggcgatgaagacctgcagtcacatgccaggggttccagcacacacgagggaactggcaagagaggttaaagccaggagaagctgggggtcagagggcagggcagttcgccctggggtcagagggcccacagcagtgggtctgggatccccaggctggcagaggatcccagggcagagagtggctgggcaggtgggaagcccggagcctccctgcctttcccaaactgctggcgtctctctctctgaatgggccaccaaagggagttgctacccacccgacctgggctgagcaagccccagcctgcggtggggatggggggagccttgagtctgagatgaccatgaagctccagcctgaagtggctccaatcttagggtagctcccgggctagcttgcgcagcatctcaaaagtaagtcatcctgtattgagtttcttctcagatctaagtgaacagctgaggtctagcagggccttgcctgacaagggctcacaccctgctaactttccaaggggctggaggggctgccccttcaggtgtctgggggacttgggggcgggaggaggtcttcctttgctttcctggcttctagaagataaggtctctcccaacatctgaagtctgggggtatcagtgccagtggctcccaccccagccgcgggagtgaggagggaaagagggggtgggatgtctgggggtgcggtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctggtagggggagataccccccttttgtattacaaaatgctacctgttgagcagccagataaaaggcgccagcgtttaatgcgtacttaaccccccgtcagagttacagcatcagagctgaaaggcaggatttggtcctaaccaagttcctttcactactaattccttggtaaacaattacggcacgatccacgtcagtgctctgagactggggcggggcaggatgagaaagggatgctcggcagtcattaatccagtgtctccggggctttctgacccagagaaacgcctattttaagtagatctcatttcaaaaatgctataatcagctactcacgggttatgactgaggttgttttccatcagccttctcgtcgttcccttttcccaatattaaaaatacactttaaaaatgtttttcttgttgtgcttaaggggcttctttaccaccactccactcccataatttctgcaaggccaatgtaatcacaataatgtctcagattcagtaatcaaatgttaggacaatggaaggcaggggagagaaaggctgtatgaccagcaccgtgcctgaagagtgaatgttcaacaaacatctcatggatgacaaatacggagctcactttgagagcgaaaccattctgcctcttctttcagagaaaggttttagagttttcccaattaatagcatgtgtattaatagagtattgctgttcagtcaccaagtcctgcctgactgtttgccactccaaggactgcagcataccagggtcccctgtccttcactatctccagagtttgctcagactcatgtccattgagttggtgatgccacccaaccatctcatcctctgctgccctcttctcctgccttcaatctttcccagcattagggtcttttccaatgagttggctcttcgcatcaggtggccaaagtatcggagcttcagcttcagcatcagtccttccagtgaatatttagggttgattttctttaggattgactggtttgctctccttgctgtccaagggactcttaactttctttaaatttttggctaattagctctgtatgaaaatgtagaaattactttcttataatgtaaggcaaatgtcagagacagttcatcaaagtgtctttatggaataaaaaaaaaaaaagctagctaattcttccatacatggtggaagacatttacaatgaaatagagattttctttccttttaattatcctcttggggtggaggtcaggaaaggggtgaagaagagagaaaatccaagcccgttaaatctttttcaagcctgatgcctgggtttgattcaagctcactgctaactccattagctgggatgcatgccaaagagaagtccagatcctacccttcctgggcttcataactggtgtttgaactacaggtcctgttctctgaaatggccttgtttaaaaaggaataaacccagaaatctctttatgtaggacagatgagtacccaaaacaatagactgccctcatatgagacagaaatgcagaaaacacctagctgaaagcacagtccagcactgaagactctctactgattatctcgaactctatttcttacctgcctgtgggacctccctgagcactacatttcagctgccttcatccggatgggggtttctcacctctgcacctttgcctctggcatgaacttgcccagtcagctgccccaaccccatttctaaccaacacagactttgcttccccatgaagccctccaccatcactgagctgcaagaggctaatcgctcctccttctttcttattccatatccctcgttcttcctaagtcctatattgttgttgttttttagtcactaagtcatgtccgactcttttgcgaccccatggactgtagcccaccaggctactctgtccatgggattctccaggcaagaatactggagtgggttgccatttccttctccagaggatctttccaacccagggattgaacctgtgtctcctgtactggaaggtgtattctttaccactgagccactggggaagccccccaaagtcctatgttacttcctactgaatgtcttgcttctcttttagactctttgcaaatgggagctcccttattttatattatattgatatttgccctagagcatctagcacagtgcctgagacatggccatttctcggtatgtatttattgcataagtgaaagcaattgttcatggattctcaaatgagtggagtttcgttgctccagacagcaagatccccctctgtcctgggggaagacatttctaacagctttctaaagcgttggttgcctatgggtggtcaacaaatataattgtcttgtcagagtcggacaattctctttgatgcattaaccctttaaaaaaatttttaccaacgacagtgggctggaaagccgtgaaaagctttctcagttgacttgtaccagctgcttccttcctccctgtctccttctccatctcctcccaccatatggctgggagacggtctgtgtgctcccatagaacaccagctaggagacccagctggaagcagtcaaagacaattagaagtaatcaggctggcatggccaggaaatgaaagttggctggagggagttaggctggcagagccggctggtgactggagagggaaagcgaagacagcaggcacgaagaaactttgcctggaagacaattctctgagcactaccccttgatcctccccaaagaaagctgtcggttaatcagaggcaggactcgaactcatggtccccagagttcatgtccaccgtgatcttgtcacagcacagaggctgaggaaggcggggtcccctccgctagggtggggaggcaacttcggctggctctggagagcggaccacgtgcagcacctagcagtgaactccttgtctgaaagtgagtcgtgactcactgtctccccgtgccccagtctcctccatctataaaactggggtattgaggaagcgtgaggattcagcgagatgatgcacacagagcattcagcccagaggctggcactgagaagcacctggtaaattttagctctcaccccttcagtcaatactggcatcatcaccacacttggagaaatcactccagaatgccacacacacaactgcccttatcacagaggaagccaaagcatttcctccagtttggatcacttccctaagtccagagtcctgtgaccaaccaccttcttctccaccaggctgtctgaaaggatctcggacttacactgggctcagtgcacacacacacacaccaccctactcctatcctagggcttcacccaaattcgccccaaaatttaagagtcatcctctgctttctctccttcctgggtctcatatccagtccctcagcaaatgtcagttccgttcagttcagtcactcagtcgtgtccaactctttgtgaccccatggactgcagcacgccaggcctccctgctgctgctgctaagtcacttcagtcctccctgtccatcaccaattcccagagttgactcaaactcatatccattgagtcggtgatgtcatccaaccatctcatcctctgttgtccctttctcctcccaaattcaatctttcccagcatcagggtcttttttagtgagtcacttcttcgcatcaggtggccaaagtattggagcttcagcttcagcatcagtccttccaatgaatattcaggactgatttcctttaggatggactggttggatctcctttcagtccaagggactctcgagagtcttctccaacnnnnnnnnnnnnnnnnnnnnnnnnnnnnnnnnnnnnnnnnnnnnnnnnnnagctggactatacaaatgtcatgggttttattttcacaacccacccacgtttgaccagagctcatcaccttcacctctgtcaccctcttcaagctagccaccaggctctctctcatcctaatccatgtcttaaaggaagtcagccctgagtattcattggaaggactgatgctgaagctgaagttctaatactttggccaccagatgcaaagagccgactcattggaaaagaccctgatgctggaaaagacgaagggcaaaaggagaaggggactgcaaaccatgaaatggttagatagcatcaccatggactccatggacatgagtgtgagcaaacccaggagacagtgaaggacaggggagccttgcgtgctgcagtccatggggtcacaaagaatcggacacaacttagcgactgaacaataacaacagtttaaggtttggtcccttcctccaaattccagagggaggctattgagaaggaatgcaagttaaagtgttttctagaaagaggccctctcacctcctcctccaccgaccatttctccttgcttgcgtttctcattgtcggtcaacaccaacaacatcctcaccagcaacgtccctgtggaccacgaagcccttccccttctgtgacccctcccattacttctccgacctcacctccccttttcactccagtgaagccacaccaggctgcctgttgctcccacacgtaccaggcttactcctgcagcgggccctttaacttatgcattccctaaaaaaacttcctcccaaatacctgcttcttcgggtcttggttcaaatgtcaccccctctgtgagcctgggtctgaccccttcgtttacaatgcagacctcccccagactctcacctccccaactccctcttcctgttctctgcttgattttccttcctggcacttaacaccaccgacaaatcatgcattttccttatttactttgtttactctgtctcctttcctagaatggaggctccatgagggctgggactttagttcagggctctcggcctggagccaggcgtacaggaagtactcaatacacatctgtcctgattgaatgaatttgtaattcacaggttctcccacagccaaagaggggaccgtgatacacgagaaagcagaaaaaaagaaacacagcgaaactgagttccgctagagaaagcatacatcatcaagacagatttgaaagaaaaaaaaaagaatcaataaccatgccacaaagataaacctctgagcaagctcatttgtagtgtgtcaggaagggaaaggctattattagcactaaggttggaaattgatgacctccattatgggtgctaacccttgtctggttcttgctggtgactgggcggcacccggcagcatcctcgggtctgcagtgacccctgagtgagcacacaaagtggagcagctctagaatgtgagtgctaggcagagggtcagaaaggaaggacactggagaactgagtccactcatccgttgcaggtcgggcacacaggcaggctgactgcacaagcctgccctgggcggtccagtggccggactcagacaaaagagagtcaggcgccgcctgctggcggctgggctctgatttccctccactcaactgcccaaggagccacagacagaataccagtctggaaaccagaatcgaccctcacctgcccgttcggtgaccctgagtagggcatctactatctctgacttcacttctgctgctgctaagtcacttcagtcgtgtccgactctgtgcgaccccatagacggcagcccaccaggctcccctgtccctgggattctccaggcaagaacactggagtgggttgccatttccttctccaatgcatgaaagtgaaaagtgaaagtgaagtcgctcagttgtgtctgactcttagcgaccccatggactgcagcctactaggctcctccatccatgggagtttccaggcaagagtactggagtggggtgccattgccttctccagataaaatgaagcaaattggcgtgaatgtgcctctcttaaatggaagctactttggtcattggtgtcttaagccaaaacgcaaagtgtctggggcatacattctcgtggttgttcagtctctaagtcaggtctgactctctggcgatcctgtggactgtagcccgccaggttcttctgtccatgggattctccaggcaagaatactggagtggtttgccatttccttctctagggaaactttcagacccagggatcaaatccaagtctcctgaattggcaggcagattctttaccactaagccaccggggaagccctgggtatacattgtatgtattagctactcagtcgtgtccaacactttgtgactccatggacaactccatggttgccattcccttctcaaggggatcttcccaacccaggaatcgaacctgggtctcctacattgcaggcagattctttaccatctgagccaccagggatatactttcgaaaacaataaatttaaaataaaatggaaagtgaatggttgaaaagatgtggttattcagagcctcttcctttcaaggcagaggctttctggggagtactgacatgggtagagacatcttcatttgtgcctacggtcgtaagtccatccacataccccacctcaggcctccttgaacgatgaccttccaatgtttctccttccagtaatgttaatcgctcagtatccgaatctttgtgaccccatggactgtagcctgacaggttccgctgtccatgggattctccaagcaagaatactggagtggattgccgttcccttctccagagacccctcatcagctgacaagccatctgttactgctgatgagtctatgtgtagagataggagatagatggttgacatatgttttccatctagaccagcagatgaccagatacaccactgaagctccacccattagaaggaaggccaatcctggggacagtcatagcgaattactgtgtttttggcttgtaaccatacataccaaccaacacccaagcttgtcctttttcctcctccatcagtgagccaccagatcccccttccaaatgtggccacagacatgagctgacggaaggttgcagattccacaatggtatagttatggagatctgagctgccgcttgtatagcttgcttggtcctcaggccctggttatgctccatcccagaagacttcactggggatggctggtccaagtccaagagccatggatgggaagttccttctggctgttggcaggaggccccagtgccttgccctatagacttctccaaatagtttgactatcctcatgacaaggcttcctctcagtgcagtaacctgtaagagaaagcaaggcagaagcctcaataacttctctttcaagaattttattgagttttaatagacactgagaacttttgtatacttaaggaatacaactggatagtttgatatgtgtacatattgcaaaatagtcacaataatcaagtcaataaatatatccgtctcctcacattcagttcagtttagttgctcagtcatgtccaactctttgtgaccccatggactgcagcatgccaggcctccctgtccatcacccactcccagagtttactcaaactcatgtccattgagttggtgatggcactcaaccatctcgtcctctgtcgtccccttctcctcccgccttcaatctttcccagcatcagggtcttttccaaagagtcagctcttcacatcaggtggccaaatattggagttttagtttcaacatcagtccttccaatgaacacccaggactgatctcctttaggatggactggttggatctccttgctgtccaagggactctcaagagttttctccaacaccacagttcaaaagcatcaatttttcagtgctcagctttctttatagtccaactctcacatccatacatgactaccggaaaaatcatagctttgactagacggacctttgttggcaaagtaacataactgctttttaatatgctgtctaggttgtcataactttccttccaaggagcaagaatcttttaatttcatggctgcagtcactatctgcagtgattttggagcccaaaatctgaagtctgtctctgtttccactgcttccccatctatttgccatgaagtgatgggaccagatgccatgatcttagttttctgaatgttgagttttaagccaactttgtcactctcatctttcactttcatcaagaagctctttagttcttcttcactttctgctgtaagtatggtgtcatctgcatatctgaggtaattggtacttctccccacactcttgactacagcttagccttcatccagcccagcatttctcatgatgtactctgcatataagttaaataagcagggtgacaatatacagccttgatgtactccttttccaatttggaaccagtctgttgttccatgtctagttctaactgcttcttcttcacctacatacagaaatctcaagaggcaggtcagatggtctggtattcccatctcttaaagaattttccacagtttgtagtgatccacacagtcaaaggctttggcatagtcaataaagcagaagtaggtgtatttctggaactcttttgctttttcgatgatccaacggatgttggcaatttgatttctggttcctctgccttttctaaatccagcttgaacatctggaagttcacagttcatgtactgttgaagcctggcttggagaattttgagcattactttgctaacgtgtgagatgagtgcaattgtgtcatagtttgagcattctttggcattgcctttctttgggattggaatgaagactgatcttttccagtcctgtggccactgctgagttttccaagtttgctgacatattgagtgcagcactttcacagcatcatcttttaggatttgatatagctcaactggaattccatcacctccactagctttgtttgtagtgatgcttcctaaggcccacttgacttcacattccaggatgtctggctctaggtgagtgatcacaccatcatgattatctgggttgtgaagatcttttttgtacagttcttctgtgtatttttgccatctcttcttaatatcttctgcttctgttaggtccataccatttctgtcctttattgtgctcatctttccctgaaatgttccctttatacctctaattttcttgaagagatctctattctttcccattctgttgttttcctctatttctttgcattaatcgctgaggaaggcattcttatctctccttgctattctttggcactctgcattaaaatgggtgtatctttccttttctcctttgcctttcacttctcttcttttcatagctgtttgtaaggcctcctcagacaaccgttttgccttttgcctttctttttcttggggatggtcttgatcactgcttcctgtacaatgtcataaacctctgtccatagttcttcaggcactctgtctatcagatctaatccctttaatctatttctcatttccactgtataatcataagggatttgatttaggtcatacctgaatggtctagtggttttccccactttcttcaatttaagtctgaatttggtaataaggagttcatgacctgagccacagtcagctcccagtcttgtttttgctgactgcatagagcttctccatctttggctgcaaagaatataatcaatctgatttcggtgttgaccatctggtgatgtccatgtgtagagtcttctcttgtgttgttggaagagggtgtttctgtcacctcatatagttacctttttttgtatgtgtggtttgagaagacttaatgtttaccattttagcaagttttcaagcatacaatataatattattaactatagtcactttgttgtattacattagctctccagagcttatcttgtgtaactgaaactttgtagcccttgaccaacatctcctcgtatcccctactcccagccccatccagttgtccacttctttcatcttttttatttgtttgtttctggccacactgcgtggcatacaggttaattcctgaccagggatcgaactcccaccccctgcaggtgaagagagtcttaaacactggaccgccagggaagtcccatcttccctccttttctatgagtttgatcatttttgattctacatattaataagagtatgcaatatttgtctttctgtgtctgccttattgtacttagtattatgtctttcaggttcatctgtgttgttataaatgcccgtatttccttcttattcatggctgaataatattccactatatttatatgccacattttctttattattcatccacggacaaagatttaagttgtttccatattttggttattgtgaatactgctgcaatgaacataggagtacagctaactcttcaagataaggattcatctctcttagatatgctttcataagtgaaattgctgatcatatggtagttctatttcaattttttgagggccctctatactgttttccatgttgttgctgttcagtcgctaaatcatgtccagttctttgcaggcccatggactgcactatgtcagggttccctgtcattcactgtcttctggagttttcacagatttgtgtctattgagttggtgatgccatctaaccatcttatcctctgctgccctcttcttttgccttcagtctttcccagcatcagggtcttttccagtgttcccactgttttccgtagtgtctatgctaatttacattcctaccaacagtacacagatgttccctttccctgcatcctcaccaacatttgttatctttcgtctttatgataataaccattagcacacgtgtgaggtaatctctcattgtagttttgatttgcacttacctgatgattagtgaagctcagcacattttcatgtatccgttggccatttgtatatcttcttttgagaaatgtctattcaaatcctttgttgttcagtcactctttcacgtctgactcttgagaccccagaactgcagcacgccaggcttccctgtccttctctatctctcagaatttgcgcaaactcatgtcctttgagttggtgatgccatccaaccatctcatcctctgtcatccccgacttctcctgccttcagtctttatcagcatcagggttttttcaatgagttggctctttacatcaggtggccagagtatctgagtttcagcttcagcatcagtccttccaatgaatattcagggttgatttcttttaggattgactggtttgatctccttgcagtccaagggactctcaagagtcttctccagcaccatagttcaaaggcatcaattctttggccctcagcttttttcttgtccagctctcacacccatacatgactactggaaaaaccatagccttgactatacagatctttacccattcagattcagatcctttacccatttttcaataagcttatctgcttttttgttattgagttgcatgaattccttgtatattttggatattaattaaccacttatcagatatgtgatttgcaaatattttctcctatcctatagttaccttttcattttgttgattgtatcccaggagagtactcccaaattgataagctctcctctatctgacttcatgttccacatcccttcatccaacatctgagaattcacttccttctgttcttctgcttatgccagcacgctttggctaggtcctacaacatatggttgcattgctcccttattcagactagcacttcaccaaatatgttatgttgtgacttaatcctagctactgatctcttggccaggaggggaggttggaccaaggcttctgcaccatgcccaaacaagaggaaagtgttagcccttaacagggggatgagaccacaacagtaaagaaaagtgaatcctccactgtcaagatggatgtgaaaagtaaaggaaatgcaatatatgtggagaaaaccatattttcaaaaagatacatgcactccaatgttaattgcagcacgattacaatggccaagacgtggaagcaacctaaatgtccatcacaggagagatgcattttagattccacatataaatgacagccatattactcagccataaacaagaatgaaataatgccatttacaaccacataaatggacttagagattatcatcttaagtggagtaagaaagagaaaggcaaatatcatatgatataacttatatgtggaatcgaatatatgacataaatgaacatatctataaaacagaaacaaactcacagacctagaggacagacttgtcgttgccatgaggcgaagggggatggattagggatgtgggattagcagatgcgaactatcaaatatgaaacagacacacacagttcagttcagtcgctcagtcgtgtccgactccttgcaaccccttgaaccacagcacgccaggcctccctgtccatcaccaactcccgagtttacccaagctcacgtccatcgagttggtgatgccatccagccatctcatcctctatcgtccccttctcctcctgcccccaatccctcccggcatcagagtcttttccaatgagtcaactcttcgcatgaggtggccaaagtattggagtttcagcttcaacatcagtccctccaaagaacacccagggctaatctcctttaggatggactagttggatctccttgcagtccaaggggctcttaagagtcttctccaacaccacagttcaaaagcatcaattcttcggtgctcagctttcttcaccacccaactctcacatccatacctgaccactggaaaaaacatagccttgactagacggacttttgttggcaaagtaatgtctctgcttttcaatatgctgtctaggttggtcatagcttttcttccaaggagtaagcatcttttaatttcatggctgcaatcaacatctgcagtgattttggagcccaaaaaaataaagtctgacactgtttctactgtttccccatctatttcccatgaagtgatgggaccagatgtcatgatcttagttttttgaatgttgagctttaagccaattcactctcctctttcattttcatcaagaggctttttagttcctcttcactttctgccataagggtggtgtcatctgcatatctgaggttattgatatttctcctggcaatatcctactatatagcacagggaactatatttaataccccatgataaaccatggagaaaagaatatgaaatccaatatatacatataactgtatcactttgctgtacagtcaaaattaacacattataaatcaactatacttcaatgaaattaatttttttaaataaaagaaatgtgaaaactaaatgctatttttagatcaaaagcataaaacagaaaatacaaaccaatctcaaaacagaatcaataaagaatattcacattaaagcttatacaaagaaatctaaatgcataatagcaaattctgagtccagccttgtaccaaaaatgtaataaaagattttaatgcattccaccttaattaaagtcaaaattatagcctatttggtgatacagtacagtgtacaaaagaaaacaggcataaaaataaagctttggtggctaatctatggtgtgccttcatgaatttcaagagagtgctgaagactggcaaggaagaaaagtccaggcagcaaggtaaaaacaattcaatggaagtattctgagaaaaaccactgggcttttttttcccatttaacacacagaagaaaagaaatgtgacatgtcattgatgagctgggataggaatgtatttctatttccattacttatgctaccgatgagtttctagacttcctggggtttctttccttccggttttatcgatatatagcactgtataagtttaaggtgtacaacacagtacagtcagagatcatgattatgacaataaatttaatgaacatccattgtttcacattcacataaaattaaacattaaaaatttctcatctcttgtgatgagagctcagcacttactcccttaacaacttgcatatataacatgtgtgtgtgtgtgtgtgctcagtcgcttcagtcatgtctgactcttggcaaccccatggactgttgcccaccgcgttcctctatccatggggattctccaggcaagaatactgcagttattcgccatgccctcctccaggggaccttcccaacccaggaagtgaaccacagtctcctgcactgcaggcggataacttactgtctgaaccaccaggggaggtgaaggtggttaaaaagtatacaactccagttatcagataagtaagttctgaggatgtaatgtagagcctcctgacggtcaccaacaatacaatgttgtacatttgaaaagggctaaaagagtaactcatagtaagattcaaaattgtagctatatgacataatggatattaaccaaacttaccatggtaatcacttagtaatataaacaagcatcaaatcattatgatgtacagtataaactagtaaaaccttaaatgttaaatgttgattatatttcaaagaagggggacaaaactactatatatcattttattttttatctaaaaattggaaaccttttagtattttattccaccaatgatgtttgctgtaagagacatgagcagatatggattttacaggttatctccctgatacagttgaagtacgtggccatcacactggctcacttcaatataagataccttgaagccaaatgattcatagaatgtgcaacttttaagcgtgtagaatgtacagtacaagcttaaggagagtttgattatacacagatgatccattgtagctgcagctacaacagcatcatgtgtatgacagccggtttccttattctgcaactctagtgagactataaaagttagattatgcatcaggataacacccatcattaatacaactagaggtgtgccaccatgaaagagacaagatggtccccaaccagattaaaactcatagaacacaactgtgttccaagagatgaaatgtcatatcactatcataaaactgaaaacttaaatcatctctttgtgtgcatctaggctccgggtttttgttcaagcaagtttgcaagtcatgcagcacaagtaatttgctccgtgacgcctctcaccctgcaattttctctgctacacagaaccaagatgaattggtttgcagggggattcaattactagggacgcatttcattttcaaatctgaacgtttttgcaaagatggctatttttagaaagcctcctgagatttcttttcagaagcactcctgattttatggaaattaaaaaaaaagcaaaagtcataaagatcaacatttagaagagattaaaaaaatacatgaatgctttattgttttaaagacaagaaatctcatttaaaacttgcaagtgcatgaacctagagtctgtcatacagagtgaagttggaaggagaaaaacaaatatcgtttattactgcatatatatggaatctagagaaagggtatagatgaacctatttgcagggcagcaatagagacgcagacatggggagtggacttgtggacacagtggggaaaggagagggtgggacgaatggagacagcggcactgacatgtaagcattaccaggtgtagagtggatggctggtgggaagctgctgcatagcacggggagctcggcttggtctctgtggtgacctagagggatgggacgggagagggttagggggaggcccaagaaagaggggaacgatgtacacgtatcgctgattcatgctgttgtaccttagaaactagcacaacattgtaaagcaattactccaattagagtaaaaccaagcaaggatgcttttgttaactcttcagttgtggttcctcaaaaaaaaaaggaaaaccataatgtagaaatatctgtgaaagatcttgaaaacgtgcttaccttctgacccacagtgttgcttccaggaatttattctgaaaagaaatctcagaagaaatataaagacatgcacacaaatatgtttgttgcagaatttgcttatagcaaaatattgggaaacatccaattgtccagcattaaggatcaaatgcataaaatatggtacctctgaaaatgccatattgcatgcatgtgtgttaagtcacttcagtctctttgagactctatggactgtagctcaccaggctcctctgtccatgggattctccaggcaagaatactggagtgggttgccatgccctcttccagggaatcttcctaacccaggggtctcttacgtctcctgcattagcagggaggttctttaccactagcaccacctgggaagtgtgggagaatatttatgcacacagaaaaggtttaatattaagcagaaaatattataaggctgctgctgctgctgctaagtcgcttcagtcgtgtccaactctgtgcgaccccatagatggcagcccaccaggctcctctgtccatgggattctccaggcaagaacactggagtgggttgccatttcctcctccaatgcatgaaagtgaaaagtcaaagtgaagtcactcagtcgtgtccgactcttagcgaccccatggactgcagcctaccaggctcctccatccatgggattttccaggcaagagtactggagtggggtgccattgccttctccaaggctagtggcatttatagaagtaatggttcagtaagaagaacatatgtgtatatagtccatgcattgaaaaaaatagcagaagcatattttaatagtgattatctccaggtagtagaataaagttgatatttttttcacatggcttgagcttttctgtttgtgcaatcaacaaacatttgttgtttatcttctgtgtcctgggaactgtgttagcttctgagtgtatatgagatggtttgaaaacgtcatcttaattttttcttcagctttattgagatatatctgactttcaactttgtgtaaatttaaggtatccaacatgatgatttgatatgtgtatatatggtgaaattattaccacaatatggtgagttagtacatcttcatctcacatagttcttgtgtgtgtgtgtgtttggtgagaacatttaaggtgtatcttcctagcaattttcaagtatacagcttctaactatagtcaccatgctgtacattaaaagctcagaactcacttatctttcattaattttattttttatttattttggctgcacccagccttagttacagcatgtgagctctttagctgcagcgtctgggagtctagccccctgaccagcagtggaacccatgcgccctgcgttgggagagcagagtcttagccactggggaagcccagaacttactcatcttacagttggaggtttgtcagcttttaccagcttcacacatctccttgcccttcccctgtaaccaccaagttaagcaagtctcttccccagtgcactcagaatggtcatcacccaaacactcctcatgggtgctcccaccctgaacccagttactatgccgtgagacaccctagtcagccgagacatgtggaggcgttgggctctacagtcccagtggagcccagctctcagtgagcctggctccggccccaggcaggtcagggaaggagccaaccagatgtgcttcctgcagcctttgctctttctgctccagcctggagtcctgcctgctgacaccaagccatcacgcgcagagaagactcatccgcacagtgccctttccaaatacctcacccacagaatgtgtgagcacgataaagtgattgctgctaaatgccacccaggagcttcggctcagttctaaagaatatgcctgccaacgcaggagacatgggtttgagtccctgatccgggaagattccacacgctactgagcaactgagcttgtactctgcaactacggaacctgtgctctagagcccggaagccgccactactgaagcccaggttcggtagagtcctctctccatatcaagagaagcccctgcaatgagcatctcatgcaccgcaactcactctagtattcttgccaaagacccagcccagccaaaaataaagaaagaaagaaaattagttttcaaaatgccaccaaatttggggtgcttttttacacagcacagataaccggaacagtgtgtcacagtgacaaacacactggtagaccaggcagacagcagaaaattgctccagcaagctgcctgccttctctcccaatgggtctttgtcattgcgtgggttttctctagttggggcaggtggcggctcctctctagttgcagtgctccaactgctcattgcagagccttctcctattgaagagcacgggctctagggtgctcgggcttcagtagttgtgacatgtgggctgtaggtttctttccagtgggaggcagatggcccacttggaagggaaacgggagctgattcaacgaaggaaattgttggtgtccaactctgcaaccccatggactgtagcactccaggcttccctgtccttcactatctccccgagtttgctcaaactcatgcccattgagtcggtgatgccatccaaccatctcatcctctgctgccctcttctcttgctctcaatctttcccagcatcagggttttttccctgagttggctcttccatcaggtggccaaagtattggagcttcagcatcagtccttcaaatgaacacccaggactgatctcctttaggatgaactggttggatctcctctcagtccaagggactctcaagagtcttctccagcaccacagtttgaaagcatcagttcctcggcactcaatgttctttatggtccagctctcacatccgtacatgactactggaaaaaccagcaaaggataagccataaaagcatgggctgctctggggggaaccaagagagaagagaagccctctgagacttaggaaagcagaagcatctctcagcctcagaccaggagaagtgagaggaggcaggaatgtcaagctgtgaacagcagcccttcctgtccacgctcccctctgctggggcctcctgatgtccaaacccagtaggaagccagagggcaaggagctaagctgatgtcatttgggaaattgcttctgtgatgccaggagggtagaggggctgagggcagtcctggggggagaactggggggccacgtccccttgtctcacagaggcagggcagatccttgagtttaagatttttctggaataagtcaaacaccagccaacaggatcccccctccacagccgtgggacacaaagaacaagcactcagggtgggcccatgggatcacctttctctaaacttagaaagaagggcaagcgtcccttcctcccttttaggttggaaagactccaaattcatcaaccactctctctaaggaaaatcctcctctagcttcatggaaaaagtgacagattttatttcttgttctcaaaaatcactgcagatggtaacggtagccatgaagttaaaagacacttgctccttggaagaaaatctatgaccaacctagacagcatattaaaaagcagagacatcactttgctgataaaggtccacatagtcaaagctatggtttttccagtagtcatgtatggatgtgtgtgttgtatcataaagaaagctgagcaccaaagaattgatgcttttgaactgtggtgttggagaagattcttgagagtcccttggactgaaaggagatcaaatcagtcaatcccaaaggaaatcaatcctgagtattctttggaagaactgttgctgaagctgaggctccaatactttggccacctgatacaaagagccgattcatttgaaaagaccctgattctgagaaagattacaggcagggggagaaggggaggacagaggatgagatggttggatggcatcatcgactcaatggatatgcgtttgaacaagctctaggagatggtgaaggacaaggaagcctggcgtgctgcagtccgcagggttgcagagtcggacatgactgagcgcctgaacagcaacaagcttcactcttagtccttttgtgcactctatatgtctgagaaaacagggtcttaacacctttctaccaaccttgcctggtactcccacatgaaaagtgaaatgtggaatctcttgagaatctaggttaaaactagacaagacagctccgttatcacttcctgtcagccatgtagaggtggcaatttaatgtttgacacaaagggtatttaaataagaaaaaaaacagccattcaataactaaggatacgatacctgattatcaacgaagggcaagacttaaattcccacttcacaccattcatacaaataaattgcatcaggattacagctccattttaaagtattagctggaaatagaggataatacgttcatcctcaaccttcttaagagacaaaaataaacacatgcgcgcacacacacacgcacaaaaggccccatccactgggctctgacacccaccactgtgtggcactgaggtccccattttcccatgagctactcccaggcagtgatgagcgcagtggggatactgaggcagcccactcctgggagcaaggaggacgtcatgggcacaagtcccaagctgccactcagagccttcctctcataagagccccgtgcatgctttcaaactgtccgctgttaataatttgttaacaagggaatcctgcatgttcacttcacccctggccctgcatatgatataacttggtcctgcctgagagacaggtgaccccctaggtgggctcgaggactgcctggcatccttacacagaatcttccttaaactgcatgtcagtctgggttgcaccagaccctccctcccttcttccatcaaggtctactgagagtgcaaatcgttcagtcatgccctactctttgtgaccccatggactgtagcccaccaggctcctctgttcctgggatttcccaggcaagaatactggagtggggtgccatttccttctccaggggatcttccccacccagggatcaaacccacgtctcctgcttggcaggcggagtctttaccacggagccacctgggaagcccctgccgtctgagttggtaggtcacaaagtagcagctcagttgctaaagctttcattggtggtggcctggaaaagtgtcctggtgggagggacatgtgaaaaacctgggggggaagcctacagagatggcagcatgggctgagttatactaagtcacgctggtgccctgcagaaggagaagagacagcaaatgacagagagtgaggactcccagagtatcccagtgggagttcacaaggaggcccagatcagctgcaaaggaaggatacacacgggccagttgcaggctaaaatatggttcagctgctgctgctgctaagtcgcttcagtcatgtccgactctgtgcgacctcgtagacggcagcccaccaggctcccccgtccctgggattctccaggcaagaacactggagtgggttgctatttccttctccagtgcatgagagtgaaaagtgaaagtgaagtcactcagtcatgtctgactcttcacaaccccatggactatagcctaccaggctcctccatccatgggattttccaggcaagagtactggagtggggtgccatcgccttctctgaaaacatggttcagctgcagctaactccagagatgtttgaatgctcagccaagggaggtatgggatgcaaaagtcatggccctagtgaggacaacctcgatggatacaacccagcctgtagaataaatccaaacagaaacagggagagacaagagacagagaggacacaatatggcatgagactctggatccagccatctctcactcaaaattcagtcttgtccaattctttgcaaccctatggactatagtatgccaggctcctctgtccatgggattccccaggcaagaatactggagtgggttgccatgccctcttccaggagatcttcccaacccaaggatcaaacctgcatctcctgcatctcttgcatttcaggtagattctttaccatggagccatgggggcaacctggatccagccacatgtaaaaccaaatccacctctgggctttgcagctttgagagccagtattatttcctttcactaaaagttcagttcagccgctcagtcgtgtccgactcttcgtgatcccatgaaccacagcacgctaggcctccctgtccatcaccaactcccggagtccacccaaacccatgtccattgtgtcggtgatgccatccaaccatgtcatcctctgtcatccccttctcctcctgccttcaatctttcccagcatcagggtcttttccaatgagtcagctcttcgcagcaggtggccaaagtattggggtttcagcttcaacatcagtccctccaatgtgtgaatcaagtgatttttgccacttgcactgcagagtagtcatggcttccctttatgtatcttcttgcatggataagcatctttaagtattccagcaagaatatctgtattttttccttcatatttttgcagaaagggggaaaccatagattcatacagagcatgatatgattctcttaatccagagatttatagaattctgtaagtctataagttggtctcatttcaatcaagaaagttgtcatggtagtctggaatccatttcattccttcattctcagcaacccactttgaggcttcctcttggtggacaattagttttacataggatggttccagattactttttaagccctgttttatacaatctaggtccagaactaatctcctcaactccatgggatttacatcctagctttctgatgatgtgaatttcttctaaatccttagaagtggtaggcctttttaccttctaatattttagaatgcattttgaaaagacacaatcaatgtggggttaaaggaatggatgttgtgatttcttcacccagtaatggagggaagtttttacttagttgtggtaataaaaaccttgagattatcctaatctcatttccacttaactcataatttgaaaaagcacacaatcatgaacttctattcagagagaatggcttaaagggttggaatttgagaatgcattgggacaagattatttattatatagagctgtttaattgacaaatatttactgaatactatggcactttgcatgattattctcaaatatttgctgcccctgtctatggaaagagaatatttccctgtgcctgtgacatcaggcaaagccatatgacttgttttagccactgaaatgtccaaagcaatgacatgtcattttcaagcctaagctgtaagaggtgatgtaagtttcaccatgttctgctttgacccctgccatgggccagcgatgttttagttcacggctgctctgtcagcttgagtcccaaagtagcatgatatgtaaacagagccatgaaagatgagcgaaggacatgcaatacaagcaagaaataaagcttttgtgttgtaagccattgagattaaggggttgtttgttatagcagcttaatataacctaccctgaataatacacagtacccatttgtgcttatcattgtgttggatgaaaaatcaacttatacatacaactaaaagcccctggcacccaaatatcgttgcttaataggaacttcttttaaataaggagtgctatgtcacagaagatttcaaacattctctaagcagcagaacccccttacgcagaacaccaactattaaactgataccagcagaattgcactggttgaaagagtgggggccaggaagttggcaggtctatctccccaaagaccatactcaagccagtgccagacatctggccagcactctgtgaatatttgctgaataaataaacagatagattatttcctacagaattctttgaagacactctgggaactctatataggtccatagagcagagtttgagttttccatagtaacactatggtgctgtaggaggtttcagatttagttgtcagatttctatatgtagactaagagaataagcagagatggtaaaaaaaattcagattttatttcagccaattgttcctacatctttccaatcacagttctatcagagatgccaatgacagttattaaaatattgagctgacaaaagcatttgtttgggtttttccataacatctggtggctcagacagtaaagaatgtgcctgcaatgcgggagacctaggttcgatccctgggttgagaagatcccctggagaagggaatggctactcattccaatattcttgtctggagaatttcatggatagagaagcctggcgagctacagtccctagggtctcaaagagttgaacacgactgagtgactaacacttttacttacagaaaaacttaagccaactctttggccaacccaatagttttgttaagagttgacatctttcccatgatccagtcaacagaagagatgctaataaatagaggggaagaaaacaaaaaaaatctaataattcactcattgggtaattagtcctaaaacaataattcaagcccctgtgctcagactgcatgttaggaagatgctagaaaactggtaagctgagagaaatggctcagcattatacattcaatgtaacaaagattcctttccttactaaatctctctcttctcatgagtgtagcctgcttgacgtaggatcctaatgctcattttattccagtaacagcgtgtgtatgtgttcagttggtcagttgtgcccaacctcttgcgaccccgtggactgtaacccaccaggttcctctatccatgggatttttaaaagtaagaatacttgagtgggttgccatttcctcctccaggggatcttcccaacccaaggatcaaacctgagtctcttgcatctcttgcattggcaggcagatcctgtatcactgagccaacctgggaagcttgccagtagcagtgacctcctagtaaaagactttttaaaaccaatcataaggtgagaatggggggtaaagtctaccggcaagatgataggttaagataaaccaccttcaacaaactcttagacctgctgcctaaaatatatttaaaagctatagcttttaaaaatccttttaaatgttatacctgagctcacaagaaagaaagaagaaatcccagggccatgtagaagagagaactgaaaaaagttatgtgcgttgacactgtagatacgaggttgccaaggcgtggggtcgagggggacgtctcctccaaatgaccaaaggacttgagtttcaatgtttatgtggggataggaactgaggccggggtgagatgaagacggaagagtcaaaaaccgcactcagagtttacctgtcaaatagcgacaacctcagcaaaagagcagaccaggaacattcatctaccagcacaggcaatagtagggaagaaagctcatctgttttctgctcaggctctggataaaaaaaataaaaggaaataaaaattttaagtcattgcctcatgtatctgagattctaatttatactagtagagtccagaaagcatcagactggaaattaatataaaaagtggtcctggaccgggggggaaagagcaggggagaagaaaatacaagatgatttctcagattctctgcaaagaaagtcacactagactgccataaaatagaaccttgctaaaggtgaacttgtatatgtattacattatatagtatatgtggagaaggcaatggcaccccactccagtactcttgcctggaaaatcccatggacggaggagcctggtaggctgcagtccatggggtcgctaagagtcggacacgactgagcgacttcactttcacttttcactttcatgcactggagaaggaaatggcaaccctctccagtgttcttgcctggagaatcccagggacgggggagcctggtgggctgccatctatggagtcgcacagagtcggacacgactgaagtgacttagcagcgtatagtatatatacatgtattcatatggggctttcctgctggttcaggtagtaaagaatctgcctgcaatgcagaagacctgggtttgatctctgggttggaaagatcccttggaggagggcatggcaacccactcgagtgtacttgcctggacaatcccatggacagaggagtctggcaggctagaatctgtccagagcagctctgtctaaggttgcaaagagttggacatgaccaaagcaccttagcatgcatgcatgcatacatatattcatatatatgtatttatgtaaacgcacaccaaacaatccacagggaccatttgttgttctgtcgctcagtcatgtctgactctttttgaccccatggactgcagcacgccagacttccctgtccttcactatctcctggagtttgctcaaattcatgtccactgagtcagtgatgccatctaaccatctcatcctctgtcacccccttctcctcctgccctcaatcttttccagaaacaacaatcataatacaaaacaaataagaggattagagaccctaagattttaaaaatcaagaatctggaaaatagcacaaattaaatatgctagaaataagtaaagaattaaatagggaacatgaaaccctataaagcgaacaaacagctataaatgacaacaaggacattaaaaaaatacagagattctagaaatacaaatatattaaatgacatcatcaataagtagaaaagcaacagattagacacagctaaaaggagaattggtgaaatggaagatagatatgatgaaattacttaggatggaatatagaaaaacaaaacaaaacatgatgtggtcactatgggatacagtatggaggctcctcaaaaaattaaagataaaactactacataatccagcaactcaacttctgggaatatatccaaaggaaatgaaaacacgaactccaaaggatagttgcatctccacattcacagcagcattatgtacaatagccaagatgtggaaacaacctaagtatccagcaacagataaatggaaaaaaaaaattgggtaaactaattatacttatctatgtataatggaatattaattagctattaaaaatgagaaaatcctaccactttagataatatggatgaatcgtgaaggcattatgctgagtgaaacaagtcagacagagaaagacaaatattgtatgatctcacttacataccaaatctaatattaaaaaataaaacacttggaaaaagatatcagacttgtggttaccagaggaagaaagtgggggaaggggaaattgaaggaaagtagtcaaaaggtgcaaagtttagttacagcataagtaaatgctaggaatgtaacatatagcatgaagactatagctaatactgctatatggtaagtaagaaaattgttaagagagtaaattctaagagttctcatcacaaagagaattttttttgtcctctttatttttcttgttattgtatctatgagaaaatggatgttagttaaatatatggcagtaatcatttcccaatattataaatcaatatatataaatatttaaatatcaatatatgtaagtatttacacaatatgtgtaaaccatgatgctttacaccttcagttcagttcagttgctcagtcatatccaactctttgtgaccccatggactgcagcacgccagtccctgtccaccaccaagtcccagagcttgctcaaattcatgtccatagagccagtgatgccatccaaccatctcatcctctatcgtccccttctcctcctgccttcaatctttcccagcatcagggacttttccaatgagtcagttcttcacatcaggtggccaaagtattggagtttcagttttagcatcagtccttccaatgaacacccaggactgatttcctttaggatggactgattggatctccttgcagtccaagggactcttaagaatcttcttcgacaccacagttcaaaagcatcaattcattggtgctcagctttctttatagtccaaatctcacatccatacatgaccactgggaaaactatagctttgactagacagacctttattggcaaagtaatgtatctgctttttaatatgctatctagtttggtcatagcttttcttccaaggagcaagcgtcttttaacttcatggctgcagacaccatcggcagcgattttggagccccctgaaataatctcccactgtttccattgtttccccatctatttcccatgaagtgatgggaccagatgctatgatcttcattttctgaatgttgagctttaagccaactttttcactctcctctttcactttcatcaagaggctttttagttactcttcactttctgccataagggtggtgtcatctgcatatctgaggttattgatatttctcccagcaatcttgattccagcttgtgcttcatccagcccagcatttctcatgatgtactctgcatataagttaaataagcagggtgacaatatacagccttgatgtactcctttcccgatttggaaccagactgttgttccatgtccagttctaactgttgcttcctgacctgcatacagatttctcaggaggaaggtcaggtggtctggtattcccatttcttgaagaattttccacagcttgtgatccacacagtcaaagtacaccttaagcttacacagtagtgtatatcaattatgtctcagtgaaactggagaaagaagtgaaagaaagaaagaacagcagatggaacagtggttaagagacttttaggataaagtcagaatatctaatacagttcctcagaatttcatggaaaagaggaaatattagaatataaaatagatgagaatttcctcggactttgggtcttaaatatgacactaaaagtgcaagcaactcgagaaaaaaatagataaaatggatcatcaaaagtaaaaacttttatacctcaaagaacaccatcaagaatgtgaaaagacaggggcttccctgatggctcagcagtaaagactccacctgccaatgcaagagatgtgggtttgagccctggtcagggaagatcccacatgccacacggcaattaagcccatgtgctaccactgctgagcctgaactctagagtccacgctccacaacgacagaagacactgcactgaagcccacgcaccacaactagagtagcccctgcttgctgcgactagagaaaagcctgtgcagcaaggaagacccagcacagccaaaaatacaaataaacgaaaaatttttttaaaagaatgtgaaaagacaatccacaggatgggagaaaagttttgcaattcatatatctgataagggatttgcacctacaatataagaaacttacaactcaacaataaaaagacaattcaattaaaatatgggcaaatgatttgagtaggtattctccaaagaaaacatcaaaatggataataactacataaaatgatgttcaacaatattagttattgttaagttgcttcagttgtgtctgactctttgagacgccacagattgtaacccaataggctcttctgtccatgggatttttttcaggcaagaatactggaatgagttgtcgtgctttcattcaggggatcttcccaacccaggggtcaaactcacatctcttacatctcctgcactggcagacaggtactttatttatatataaataaaaaaatatttttttatttatatatataaattaaaatatatatatatatatatatatatatattttttttgctgcattgtgcagtttgtgggatcttagttccactaccaggtattgaacccaggccctcggcagtgagagcactgagatttaaccactggaaatgcaaatcaaagtcacaagctacacccactaggatgactacaatcaaaaagacagacaataacaagtgttggtgaggatgtggagaatggaatcctcttacattgctggtgggcacataaaatggtactgctactttggagagcagtttgataattcctcaaaataagcacagaatcaccatatgatctactaattcctcttcttggtattcatccaaaaaaactgaaaacagatgtttaaaaaaaaaacaaaaccttgtacatgaatattcacagcactattattcataataatcaaaaaactgaagtaaccaaaatgctcatccagtgatgaacagataaacaaaatgtaacatattcatacaatggaatgcatttttgtccataaaaagaaatactaatacatgctacaacctggatgaatgttgaaagtattattctacatgaaagaagccagtcacaaaagactacataatccataatttaatttatatgaaatatccaaaataggcaactccatagacagaaagtaaagtagtggttgtcagtgacatagagaagggaggaatagggagtgagtgcttaacgggtgtgggatttcttggaatcaccaaaatcttctgaaattagacagtggaaatgatggcacaattaaaaaaattgttttaattttataaaaagtgacctaaagtcactgaattgtacactttaaaagggtgaatttcaggatatgctaattatatctaaaattttgacaggttaactactacaaacatggaaatagacaaccctaaatacaataacgcttggattgaaaaatgtttgccaagaaaagaaagaggttatgagttaattttgatgtttaaatgcacaccacaactgcagagcttccagttctcaactcacaccatcctggttttcgaggagtgatgatcaggactgccgctctgtggtggtactaaactggaaagaaatttttcttttatttttggctgtgctgggtctttgccgctgcacgcagtttctctagctgtggccagtggggctcctctctagttgcagggtgagaatttctcattgtggtggcttctcctgtaattgtagcttcagtaactgcagctggtggcgggctcagaagtctaggcacgcgggcttagttgcccggaggcttgtggaacctttgcggaccagggatcaaactcgtgtcccctgcattggcgggcagattcttaaccactggaccaccagccaagtcctggaaagaaattactcatttctaggagctgaggcaatgggaaagggaaagagccagcccaaagtgcctgacagggagggaaaaagatgaaaaaagaccccaggatcgcccttcttctgtctgctggccccctgcagtgcgttccagtggccaaacacaaacggaatccagaggtcaaggaagtccactgatggacgctgtacggatcagctttctaagacactgagcggtgtggatggctggaggaggtgaactggagagaccagtgaagagtgcattcttactccatttagcataaaattccagttagaggagaatccaagttgcccagtttggacctggttctcacctcttgggtagggaaggacagaccatcttgatttgctatgaccttaagactttaagcaaatcaagttacttttagagaaataaggcaacatagtgaccagacagtgatatctaccacagaaattatctgaaacttaaaaaaaaaaaaaaaaaatagattttagtgcttttgtaatcccaaacaactggctacaacataaaaatgaaaatgaaatggattgtaaaactaactggcacttgatcactgggtcttccatatttgtgagaggttaaaaattcagtaaaaggttaaaaatgaatctctgcaaacaatggtaaaggaattgcttccctcattggcacagccctgtgatagcatctgcaggggaggagcagtgtctgacagctcaagtctgggtcacagagttgtatttcttcatgccatccgaggaacagactcccaggttccctctatcaagcactggctgagaaactatggcacattgtggccaaagtgagacaggcctgggacctgggacacttcgcagcagtaccgcaatgcttgcacctggacacagctctccttgagcaacaaaacacacagaaactatatgggactaaaaataactgtgtgcgtgcaccactggggcaaattctagaccaaaaagacaaaaaaggaaaaaaaaatccaactgccatttctgaggagccaggagcaaaaatggagtgttcgaagcaaatgtagggtactgtgcatgccacccccctgcatgcaacaccacaaagacagtggtgagcagaccacttaagccacccctcagcccaaaacctggacacactcctaccctgccccatatatgatacaagcttgcccccactcagggagtcagcaagtaaaggaacctgttatttattctcactcccccctgctgcacagggggcccaatatgtcttgcctgaatttccctgtttggcctctagttaatttctatcgatcggggaaggcaagaaccctggtcagtatcaaagataagttgtccaagatgactcagctggtatgtggttgatccaaaatcaattctccaccatgccggactacctagagataatctcgtcaacagtaagctctaatggctaatgaggcaaccagggacgagagagaggagagttgccaaatgtcacatagctagttactgagaaagccagaataagctggtcttcggattcctcaaccaatgtattttccattacacaagggagaacagagagaatttcattatttcacgattgcctgttcttcccatcatgaaatggaagcaaaagggatgagtgaataagacccagaagaaaatgtaactgagctctgtattttgtctaagtccctctactttctttggggaggcatgagcagaactgacatgaatagctttccacgtgctccgagtactggagggcaccatatagagcagtaagtgtgtgcgctgtcagaagctgcatgcaaatttgggtgtggggaaaactcatttgattctccatctgtctccctgtttaattacttagccataaattaacattttttactagctacattcagtgactgtggatcaattcattgattttaatgtcaaatatggaatatttttgactttcaagtatttagccttttcatttatgttcacatttggaaatctaaacgaactatcaaaatctccccaaatacaatattgggattttttttttatttgtcttcttattaagttatttccttgtttgaatcgtagatgagatgttttcttggaaatactgcttgtttcccctaaagggtaagaaaagaaagtgtttttaacatttagaggatataattaggaagctgatcatggatagtgtgaactcggggccttaaagacacagagcccgtgactccgcttgaatttgtttacagcctgatcaggtgagcacatactgccttccccaccttatcagactttcatcaacagaaaaggaacagcacagtccagccccctcttgtgcgtgttctcttaaagagggcaaccttccagcttatctgtcggtgagatcaccccttatttactgttcaatcacaatgtatcaagccattatgtaagcccaacagagaaataaagaggaagagatgacttctggtattagagcatcaggatgagaacaagcccacatgagtcaaaaaatggtaaggaaacataataaaacaattacaaatatgtatagtcatgtactgggcttccctggtggctctgtcagtaaagaatccatctgctatgcaggagacatggcttcaatcagtggggagggaagatcccctggaggaggtcatggcacccactccagtattcttgcctgggaaatcccgtggacagagcttcctggtaggctacagtccatggggtcacaagagttggacacgacttagtgactaaacaaccaccaccaccatttgcatgtactagtataccctgtattgatatcctactccttcttattccttgcccacaggatccgagttctgtttcggaagacaatgtacccggctctgagaaatggatcaggattggttgaaaccagtcatgacaaccctgctccctaaatttccagatctcttgcaactacagagagccaggggatgcaggtctagctgataaaacagaataggaagacttctgtgggcttctagaaaagcttctgtctccttgatataagctctgagctgcctctcccaccctttcctgttatgaatgtagatgtgatatttggagtgatgaagccatcttgagattgcaagtgaaaggcagaaagaactgccaagatgccagccctgaaatctttgaatgcctgaactaatgccaggaaccacctaccttaggacttctcatcataagagaaaaataaatcttttgttacatgcaactgaatgcattcctaaccagtatgcacatacattgcaaaatataagtacaaaagtactaaaatgcattcataaaaggggaagagtcactggagagccaagagtttattcaaagtctgctttccaattagcctcagaacacccagctggtccaatttcagttcctcaattgggtgctgattcatcaacccactaagacagtgggttctaaagtatggtctccgggttggaacaaatgcgagagagagacatgttggtgttttgagtgatgcactcagacagtcactgaatgttctgactggcttcactgctccaaactcaccatctcaccatggacagagtgctgggaagttgctgaatcctctggctaagaagttccaaggttaaaccctctggaatcctgtgagaagcttctcagtagtcctaatagtcccagaaaaaagccagggctggacccaaagtgatctacaaattcaacacaatccctatcaaaattccaaccatttttcttttcaaaaagaaaaagatcattctcacatttctatggaattgctggggatgtggaattgggctctaaatagtaaaagcaatcttgaaaaagaactaagtcagaggactcaacacttctcagtttcaaaaattactacaaagagaaagtaatctagtgttgacagaagaatagacatagaaaccagtggaatagaattaagagcccagaaataaacccatacatatatggaccgattaactatggacaaggattccaagaccattcaatgggaaaacaacaatctcttcaaacgagatgctgagatacctggattttcatatgcaaaagaagaaagctgcgcacaaatctcatactatatactaaagttaactccaaacaaatgacccaaattaaatagttaaaaccatagaagtcttaaaacacagaggtaaatcttcatgaccttcaatttggcaattctcagatataacaccataccaaaggccacaaaagaaaacatagattaaactgaacttgattaaaatgaaaaaaatttttccatcaaaggtcaaaaggacaacctacagaatgagagaaaagatttatcaatcatatatttgatagaaatttaatatccagaatatataaagaactcctacaactcaacaacaaaaaaagacaacacaattttacaatgagcaaaagacttaaatagacatctctctaaagaagacatatgaatggccaataaacacatgaaaagatgctcaacatcattgatcatgagggaaatgtaaatgaaaaccacactgagataccacttcacacttaataggatgactataaaacaaaaacaaaaattaacaagtgttagtaagaacctggagaaattggaagccccacacatcaatgctgaaaatgcaaactggcgtggctactgtggaaaacagtttagtatttcctccaaaactaagcatagaattaccccatatcccagaaacttcactcttgtaccccttaaaaatgaaaacagggattcaaacagattcttgtacacccatcttcactacagcagtattcacaatagccaaacggtggaaatgacccaagtgtccatcaacagatggataaataaacaaatgtgatcgatccatgcaatgaaatattattgagccataaaaaaaaagtgaagttctgacatatgctacaacctagttgagccttgaaaacattatgcttagtaaaataagccagacacaaaaggacaaatattgtatatgattccactttcatgatgtgcctgacactcagagacagaaggttgattagaagtgaatgagggctgtgggggacagaatgggcagttattgcttaaggtactggttcaaaacctcaggggtctccctggtaaaagtggcctctgtacacacaggactgggtgagaccaaggaagaggcagaccgcttgagattggtaaggggcagttttgataagcgaggtttttcttgggcatctacaagataaatagatctctgcccctgtccaccagactcttaaaagtttatacagaggcatcatggggtgcagtcacacacaatccatccagatggtctcaacaacacattgctcttctacgtctgtgtccttcaaaatcattcccatgctgggggcagtgaacagaatgtgcattccaaggacagggcacaaggcacggagcctctaactgccgaggtccagctcacggggcagcaggcgggcataccccctcaatgacctcctccaacaaatgggtactaagtgtctgtttcaggtgatgaaaatgttttggaaccagcgagtaattattattgcacaactgtacttaatgcccaccttaaagtggttcagttcagttcagtcgctcagtcgtgtctgactctttgcgaccccatggactgcagcacgccaggcctccctgtccatcaccaactcccagagtttacccaaactcatgtccatcgagtcggtgatgccatccaaccatctcatcctctgtcatccccttctcctcccaccttcaatctttcccagcatcagagtcttttcaaatgagttagctccttgcatcagatggccaaagtatcataaaatggcgaattttatcttatctatacttttccacaatttttaaagattaagttgaaaaagccaaagctgggccccagagccctggtgaaagaagtcatagtcatcttgctcttggttttggagaacccagacgcctggccaaaagccccagaatacctgctcagtcaccaagaattgaatgtttcaaggtcacctgaagttgcttttttcctccccctttcaattagtgatcacagtgagttgcaacagagatatttttgccatagcttttctttgggagataatctactgaccacagtctcagaagcacatacagcaccatcctttgacctgaacatagattcctgtttccttccttacagctctcctgtaattcaagtgactgctaactaaatcggccctgtccacagagcagcaaggttggtccttcctctacttaaaggtcaccttcccttccgtcagtccttccaatatggaggccatgtgctctagtggccactcaatccagcccagggttggggtgaaagacaagagtaaattattaggactcttgtgttgatgtctcatcacttccctttaaaaaaaaaagattatttatttggctgcctcgagtctcagttgtgatcctccggatcttctgtcttagttgcagcatgcaaactcctagttgtagcatgtaagacctagctccctgactagggatcaaatccagggccctgcattgagacggtagagtcttagccactagtcagtcagtcagttcagtcgctcagtcatgtccgactctttgcgaccttgtgcactacagcacgccaggcctccctgtccatccccaactcccagagtttactcaaactcatgtccactgagtctgtgatgccatccaaccatctcatcctctgtcatccccttctcctcctgccttcagtctttccctgcatcaggatctttttcaatgaatcagttctttgcatcagggggccaaagtatttgagtttcagcatcagtatcagtccttccaatgaacattcaagattgatttcctttaggatggactggttggatgtccttgcagtccaggggactctcaagagtcttctccaacactacagttcaaaagcatcaatgcttcagtgctcagctttctttataatccaactctcccatccatgcatgagtactggaaaaaccatagcattaactagacggacttttgttggcaaagtaatgtatctaatttttaatatgctgtctaggttggttataatttttcttccaaggagcaagcatcttttaatttcatggctgcagtcaccatttgcagtgattttggagcccccccccaaacacagtctctcactgtttccattgtttccccatctatttgccatgaagtgatgggaccagatgccatgatcttagttttctgaatgttgagttttaagctaactttttcactctcctctttcactttcatcaagaagctctttagttcttcttcactttctgtcataagtatggattcatctgcatatctgaggttattgatatttctcccagcaatcttgatcccagcttgtgcttcttccagcccagcatttctcatgatgtactctgcatgtaagtaaaataagtgcagtgacaatatacagccttgatgtactcctttcccaatttggaaccagtctgctgttccaggtccagttttaactgttgcttctagccaccagaccaccagggaaaccctgatctctttcttgatttgtgttttgatatgtgttttgtaatattgacaatatattagtatggtaacacacgtctattattgacaaaaatagatatacatatatatcagaggggcgtacttaccatctttctttattgataaacatatctgctcaaaaaaaggtaggacaccagggctttaggaccttttgcgggaagatttgttgctcatcccttccgagctgtaatttgctatggacaggtattttgtgattccattcatatgaggaatctacaataggcaacttcacaagacagaaagtgaattttgtgctgcttccagcctcctaactctcggtcccctttccattctggtccttggtctgggtttcttctttatccacaaatgactaatggcagaagaccaatttgcaaaacagaatttctgagggtttgagggcaatagaagggtattaatacccgtaatcgtaagcaacttaaaattaaatatttgacattaatcttctggaatgttccttgtttattctcaccactgggaactttgctccacccatctggccctagcctcttatcaagttgctgggcccatcctcccaggagagaagccttttccatctttctggaacctcctcccttacaggcttccaacaatttccagacccctgatatttgattacacctaacaatgcagctccatcactgttcacatctcctcttccagactctatgcaaagactttaccaaggacatcttcactctgcctatgagaacagttgttttcttaggcagactctgcagtcttcccaaatggggattcccaaagcgtgagctgcaaacatctgaatcacataagcagttatttaaaatgttgattcccagtcaagaggccaatgctactgaatccagtggttggtgggggtggcctgggaagctgctcccccgtgattctggtgcacaatgagttttgagaaccactggcctctcaagtagacgattcaacctgtagatacctgaacaacatgggggttgggggacccaccttctgtttataaccagacctccatatatgtgaagagaactaaagaacccgttgatgaaagtgaaagaggagagtgaaaaactcaacattcaaaaaaagaaggtcatggtatccgattctgttatttcaaggcaaatcgatggggaaacaatggaaatagtgacagactttattttcttgggctccaaaatcagtgcagatggtgactgcagccatgaaatcaaaagacacttcctccttgaaagaaaagctgtgaccaacctggacagcattttaaaaagcagagatgttactttgccaacaaaagtctgtatagtcaaagctatagtttttccagtagtcacgtatggatgtgagagttggactataaagaaagctgagtgccaaagaattggtgcttttgaactgtggtgctggagaatattcctgagagtcccttggactgcaaggaggtcaaacaagttcatcctaaaggaaataagtcctgaatattcattggaaggactgatgctgaagctgaagctccaatactttggccacctgatgtgaagaactgactcattggcaaagaccctgatgctgggaaagaatcaaggcaggaggagaaggagacgacagaggatgagatggttagatggcatcaccagctttatggacatgagtttgagcaagctccaggagttggtgatggacagggaagcctggcatgctgcagtccatgaggtcacaatgagtcggacataactgagtaactgtactgaattgaactccatatatgtgggcttccctagcagctcagagagtaaagaatctgcctgccatgcaggagatccaggttcagtccctaggtcaggaagatcccttagagaagggcatggcaacacactccagtattcttgcctggagaattccatggaaagaggagttacagttcctggtgagctatacagtccatggggtcaagaagaatcggacacgacagagaccaacatcttcattttcactccatatacatggttctttttatccatggttcaaccaaccagtggatcgtgttgtactactggaaaataaaagccctgtttaaggggacctgctcagttcaaactcctgttgttcaagggttaactgtatttgtttttctttctgttagagccgacttactactgaacgtattaagacaaagttatcttttgccctgtaacccatcccacacctgtgttcagactacttctccaaactgtacctgggataagtatttaaacgtgaccctccaggagaaggagatggcaccccactccatacgcttgcctggaaaatcccatggatggaggagcctggtgatctgtagtccatggggtggctagagtcggacacaactgagtgacttcactttcacttttcactttcatgcactggagaaggaaatggcaacccactccagtgttcttgcctggagaatcccagggatgggggagcctggtgggctgccgtctatggggtcacacagagtcgggctcgactgaagtgacttagcagccgcagcagcagctccaggtatatgaacccagcaggtacacagtttacatggggccctgaaaagattagcaaacagcatcacttgctctgagaatacagccccacgcaagggtgagacacttgccaaggagacgtaggctgggtttcagctgggaactcttatttttttttaagagtataactgctttatattgttgtgttaattttgctgtactacgatgtgaatcagctatatgtgtacatataccccctgccccttgagtctccctcccacccaccccatcccagccctctaggtcttcacagagcactgagctgagctccgtgttcagctgggaactcgtagcaggaagcaatttacacacccctgctttggtaaaaacccaccaacataataattatcttagctctgcctctcagatttgggctccccggagtaaagtgggcaggagctagtgcctaagcttcctgggacccgcacagcaaacagctgaagcatctgcaagcaagctgttatgaaaggcttgtcttcttgatgactgttaaagagtaaattgttctgacacttgttaaaatggtaaggaagactttatttggggttattgcaatgggtgtcaggactgtctcgacaagggagagagactgggctcacctctgaatgcaaagatgggttggaacttacaggcaaggtgcagggtgagggggccagtggatggggaattactaaaggagacatcaagaggatatcttgggacttccttggtggtccagtggctaaaactcctcactattaatgcaggggacctgggttcgatcccggatcagggaactagatcccccatgccacaactaaaagtttgcacgccgcagctaagacccagcgcagccaaaataatttttaaaataaaaccagttgcctaaaaaaaaaaaaaagagtaggggattcttgctgaaggcagccaagatgatcaggtatcaagtgttgggatgaagaatctgatcacagatagaggggggaccagatattgagaatggaggggttctctttaaattaacatatcaggattcttgctacagctaggctatgcagacctggaaaagaagagaggccaaggtggaggcccagttgagaaagctcagagaaccccagctaaagtttggtcaaagcgagaatctttgtcattacacaacagaatcatcgtttgtctccctgattacgccacggtgtcattctggtctgaaacacagccaggggcttctaagttgtgctgggagggatggtccttcgccagagggccccaggagatggcttcccaagatctttagtccacctctaatattgtggttgtcagtattcttcttattctgttagctgtcatttttgcgcttgtcatcacacttgccttgccaacttgctgcttccttccagtctgctgtaaactagagagccaggctgccagctttgtgtgaaatgtttctaattacaacggtgagaacagaatgctagaattccggttgcttgttctgggagacctctggtcaaaatccccatttgaagcctggcattactcatcttcaccatttatgatttttctccctccttctgggagagaaaagattaatatacttaaggttgtattggagatataaaagttgggtgcatctccttcagagttgtaaatttcacagcactgcaacaaattaaacacatggatgatctcaaatcttttgcaagaaatgtgttccaaagaacggaaagaggcaggcccattaggcctgcccaactcaggcaatggagatgtgattgcatgctgtttctgtcagtcacatttgccccaagaaaggctacaaaaggtcccacactttccctttccaagcagacccccgtttcaggatgctctgctagcagggtgatcctggtctactcacacccctggaaacataagtcctctcatcaacagaacagaagtctgcttgattatctctaaaagatatgttatattttttaatagaaaataagggggtaggagttctcttgtggtctagtggttaggtttccaagttttcactgctgtaggcctgggttcaatccctgatggaggaagagattcagcaagccacatggagcaactgaaaaaattaaatgtttttaaaaatgttttcaggggaaagcaaaatgactctttgaggattctaggtgtcctgaagcattgattgacctcatcaccaagaataaggctcaaatcaaaagagagagtttactcttgattttggctaacaaatgcagtgcttttttaatgttttaaagtaatactttttttcccaactattagggccaaaaataagaagggaaagatggaatgaggaccagaggagctttcctgtgaacacagttggtaaactttcggcgatagattttgtgagactgaggcttactgacttgtgaaatgtgtccagcttcctgccaggcttctgggttgattacaaatagttgagctcaccaggtactgagttgattttcagttgctaagtcagatctgactcttcacaaccccatggactgtagcccaccaggctcctctgtccatgggattttccaggcaagaatactggagtgggtttccatttccttctctggggatcttcctgacacagggatcaaacacctgtttcctgcagctactgtattagcaggtggattcttgaccagtgagccacctgggaagctcagttgctcccttgagggggaaaaaaaatcagtataaataatttgcacttaaagactgttgcattgttctaacacacattcttttgccatggtaaaattccaggtaagagtagattttccactgccaagccaggggcttctctttgctgctggtagggacgcaggcagcctttgctggctcaggtagtgggtttttccccgttgtcagcaccctcacctggatggccacagatggtctccatagctgactccttgactatggaaatgaggcctcactctaactcagcgttctttaataatttcaggctataaatccatattcagagcgtaattgtctaagtgtgtgatgaaattaaaatcccacaaaatagtacttaacccttttgctatttttgctagggctgccataacaaaattccacaaactggatgatgtaaacaacagtttattttctcaccgttctggagcctggaagttaagatcaagatgtggacaggttggtttcttctgaggcctctctcctggcttgcacatgactgccttctagctggttcctcacatggtcttccctctgtacgtctgtgtcctaacttataggcacagctgcgtattggattaggacacaatctaatggtctcatgttaacttaattaccactttaaagactctatctccaggacttccctagtgattaaggctctgaacctccactgctgggcataggttcgatctttggtctagaagctaagatcccacatgctgcacagctggaaaaagaaaagaccttattttttcagtgatcatatacagatgtgagagttggaccataaagaaggttgagcatgaagaattgatgcttttgaactgtggtgttggagaagactcttgagagtcccttggacaacaaggagatccaaccagtccatcctaaaggagatcaaccctgattcatgggtcatcagaacgactgatgctgaagctgaagctccaatacttggccacctgatgcaaagagccaccttactgggaaagaccctgatgctgggaaagattgaaggcaaaaggagaaggagatgacagaagatgagatggttggatggcatcaccaactcaacggacatgaagttgagcaaactctggaagacagagaaggacagtgaagcctggcgtgctgcaatccatggggtcacaaagagctggacacggcttagggactgcacgacaacaataacaatctctgaatatagtcactttctgaggtactggggtttagaactttgacacatgagctttgaagggacacagttccctcacaacactctctgcatggatgcagcaccatcggttattttctattctgttccgtgttccaaaaatacataatgagatgctctaaaatttgacttcacaacccactaatgagacacaagccagaatttgaaaaacaccatttaacatgttggcgttactctatggtcttatgactggcaaataaaaccttgaaaaggaatcagaaagcataaaccctcagatcctaatggagatccttgcctgtcctcagggagcagtgaaaagagcaaatgctttgggtaagtcacccccaaatagaaatcccaggtttatcactcaccgggcagacttcatccaaccagagagaccactgaaacgttcagccttcctttcttcctgatttcatgagtccaagatggtgaactctgagatcctgattccagaattaaatgttggtcctgctatatcctttgatctccccggaaacaatcacacagcttatcagcagaatggggcagtacttcatcaagggaaattgtattcctcatccacaaaaattctcccataaatcagaaactttgttttcttcaggtctcctttatagctattcctctgccccatgcctcagagaacttggtttcctattatataaaggagttcctataattagtctttctaatttgaattattttttaaaaggattgttaacatctttacctttttttcaatttaattcccagtgaattaattctaagtgaatttcttttgtgcataattaggttttttcttttgaaaaaaaaaaagcctttaggtattaaaaaaagatgagctggttattaaatatgaatttaaattcttgccacctacatctcaatcttcagtgaagtttcttgggccctcccctacatcaaataatcctgctcgccaagaaaggcggacaggtgcgacacattaagatgaagctgtgagatattcccaggagaagttaggtgcacaggacagacctgaactggaaacctgcaggttaagagaaaagggcaaatcagagacaagcacccagaaaaagcaacgtacacaagagaacctcaaggaagctctaatgtggacagaaaagaaatccggacaccgtggtgccctgagctgctaggacagcagatgctttcaccaaagcccacggtggagcattttccactttctggctgaggaagggaggtgacaggtgcatttgaggagaagatgatgtcagcaccatttttaagaacagaaaggctacctgtggtagctaagatagaaagcgtttcttagccaccttttgattgtgtgtatcttcctccttctccatcttcatccacttcttttctctacagttccactccattctctcattcctctaccccatttctaaaattttcttttctttctctcttaagttttccatttccttctcctttctaaaggcatctttaagcattgctgctgctgctgctgctaagtcgcttcagtcgtgtccaactctgtgcgaccccatagatggcagcccaccaggctcccctgtccgtgggattctccaggcaagaacactggagtgggttgccatttccttcaatgcatggaagtgaaaagtgaaagtgaagttgctcagtcgtgtccgactcttagcaaccccatggactgcagcccaccaggctcctccatctgtgggattttccaggcaagagtactggagtggggtgccattgcctgctacactccacctaagcccttaaccctcattcacacagttcggccccatgatgtggaatttaaggcatcagaggcgtttgacttggattccagattttgtggtacacatactgctgtgctatgctacacattggtccctactgtctgagagcttacgtctacaatagacaatatgtagtggtcagcttttgctgagtaacaaacaatcccccaaacttcagaggcctcttgcatcaaactttgatttctcactcctgttgtaggagggctgcaggtcagcagtgcccttgctacaggtggcaggatggctttaggtcagcttcacgtgccatctcactctgggacccagaaaggaggaacagccccatgcctcatgcagttctcttgcagagggcaggagcacaagctgccaagccaaaccacataactgcacctaaagcttctggtctgaagtggcctcagtcatgttcgctcacgttccatcagctatgacaagttgtacggctgagtctatcagtatgttccacctccagggagggaacaaatagttgttgctaaaactagacctacaagtgtgtggacatatgaacaagcagaagattggtaccatgcaagggcagacatccagtagctgatgattaatgagtcagtattttcaccaatctgggtgactgtcttcaaaattaaggtattatgttctgggtaaaaaaaaaaaaaaaaagaaagattaattgtgattattgtagaaagtttggaaagtatggaagtaaaagaataaacagtatagaaaaactataattacccagacacaattttagtgcatctccttcaggaattttatctagaagtgggtgtgagggagagaggacagttaaactgtgattaaactttagagtgggcttcccttgtggcttagctggtaaatgatctgcaatgcgggagacctgggctcaatccctgggttgggaagatcccctgaagaagggaaaggctacccactccagtattctggcctggagaattccatggactgtatggtccatggggttgcaaagagtcggacacaactgagcaactttagagtatatctcacttttctttattagtaccatgtgcctttcctcatgtcagtaaaaatctatcataaatctcatactaaataaatgtgctacttttataatgtagaaacagtttgggcttcccagatggcacccgtggtaaagaactcacctgacaatgcaggagtcgtagaggctcaggcttgatccctgggtcaggaagatcccctggaggagagcacggcaacccactccagtacgcctgcctggagaatcccatggagagaggagcctggtgggccagagtccaaagagccgaagagagtcagacacgcctgagcacacatgcaatgactaactatattgagtattttttccaagtgtttattttccatccattgatcttttgggtgaagtatctgttcacattttttttgcccaccccaaaatagtttactttcttcttaatgaatcttgagctttctttatatattctgtatacaagttctttatcagaaataggatttgaaaacattctccccagttgtgagttgttttttcattcccttacagcgacttctgaagaacaaaaaattagtaattttttaaaaattgagagacttccctggtgatccagtggttaagactccacatctccactgcagggggcacagatttgatccctggtcagggaactaatatcccacacttgtgaagcaagtgtgagatgagtcctcctgtggttttgatttgccctcccctgatgattagtaacattgagattttttttttcatccacctgttgcacatttgtttgtcttctttggaaaaatgtctattcaaacccttagcctattgtttcattgggttattaattttttcagtattgagttatacaagttccttatacattttggagattatccacgtagaagatatgtgctttgcaaatattttctccaacttcatgtgttgcctttctattttgttgattgctccttttgctgtgaagaaactttttagcttaatgtagtcttgcctggttttgttttttttgtctgtgcttttgatatcattttcataaaatcattgtcaagatccatgttgtgatgcttattccttttgttttcttctaggagtttcagagcttttgatcttatggttaagtgtttcatcctagtttattttcttacattatgtatgagtacgttttctttcatttgcatgtggatattcagttattccaatgatgttgaaaaaactaaaacattcttaattttgatgaagtctgacttaacaatttttctttcgtggatcatattttaggtgttttgttcttttttactctgtattatataatactttcttattctgtgaacttttatttactttattttgttttatcattactttgataatgtaaattactttgttgatgctcgatgtgcagtgttaaatcagccttgcattccttacaaacctcatttagtcacaatatattattccttttacgtattgttgaattcaatttgctaaaactttttactattttcttctttttttattgacatacagccactttacaatattatattagtttcaaagtatacaatatagtgactcaaaaattttatataggttatattccttttagagttattataaagtattggctatattccctgggttgtacaatatatctttgtagcttatttattttatgatagtactttgtacttcttaagcccctcccccgatcttgcccctcccacttccgtctccccattggcgactactagcctgttctttatatctgtgaatctgcttcttttttgttacattcaccaatttgctttatgttttacattccacataggagtgatatcatacagtgcttgtcttcctctctctgacatttcacttatggcaacccactccagtgttcttgcctggagaatcccagggacggggcagcctgctgggctgccgtctacggggtcgcacagagtcggacatgactgcagcgacttagcagcagcagcagcagcagcaccctccaggtccatctctgtagctacaaacagcattatttcattctttttatagctgagtaatatcccattgtatatttgtaccacatcctctttaaccattcatctgctgatgaacgctttggttgctaccatatcttggcaattgtaataatgcttctgtggacattgggatggatgtatctttacaaatgagtgttttcaaggtttttgtttttgtttttagatatatgtccaggagtggaattgctgggtcatatggtagttctttttttagttttttgagaaactttcatattgttttccacagtggctataccaatttaattcccatgaacagtgtatgagagttccctgcaggaaagttttaaactggatattaaatttcattaatagacatagtgctatttacgttacctacttcttcctggatgaacttcagtatttatcaacggtgtccttttcatcaaagttatcaaatatattggcataaaattattcataatatatcctttaaatatctgtggcatctatagttatttagacctctttcattcttaatattggtatctcttctttaaaataaacttttaattttagaatacttttagatttacagaaaatttatgaagatagtacagagacttcctatatgccccacctcctgtctcctattattaacaacttccattagtaaagtaaacttgtcgacacatgttgatacatcattattagctgaagtccatactttactctgtatattgtcaccctgcttatttaccttatatgcagagtacatcatacgaaatgccgggctggatgaagcacaagctggaatcaagatttcagggagaaataccaataaatatcagaaatatcaataacctcagatacacagaaagcaaagaagaactaaagagcctcttgataaaagtgaaagaggagagtgaaaaagatggctaaaactcaacatgcagaaaactaagatcatggcatctggtcccatcacttcatggcaaacagatggggaaacagtggaaacagtgagagactttatttgggaaggtgaggggggctccaacattactgcagatggtgactgcagccatgaaattaaaagacacttactccttggaagaaaagttatgaccaacctagacagcatactaaaaagcagagacattactttgccaacaaaggtccatctagtcaaggctatggtttttccagtggtcatgtatggatgtgagagttggactgtgaagaaagctgagtgctaaagaattgatgcttttgaactgtggtgttggagaagactgctaagagtcccctggactgcaaggagatccaaccagtccatctgaaaggaaatcaagcctgaatattcattggaaagactgatgctgaagctgaaactccagtactttggccacctaatgcgaagaactgactcactggaatagaccctgatgctgggaaagattgagggcaggaggaaaagatgatgacagaggatgagatggttggatggcattaccaactggatatgagtttgagtaagctccaggagttggtgatggacagggaagcctggagtactgcagtccatggagtcacaaagaatcacacatgactgagcaactgaactgaactgatactttattcagtataataattttttttaaactcatcatttttctgttccaaattccaaccaggacaccacattacattttgtcatcattgcttcttaggctccttttgctgtgacagtttctcagattttccttgcttttgatgactttgatacttctgcagagtactcactgggaaatttttagaatgtacctcagtttgagtttgcagtttgtctgaagtttgtctttgattggacaggggttatggatttggggaagaaaaaccagagagacaaagtactgttctcatcacattatatcggatacacaccttcaatatgacatcactattgatgctgaccttgaccactggctaaggtcacgtgtgtcgggactctccactgacaagttagcctcatctcctctgtttccacagcttactcttcagaagaaagtctctgcacattgcaaacttaaggagtaggttgtttcgctccatctctttgaggatgcagtagctacataaattatttggaatttttctgcacaggaaattttttcccctcatttatttattccaccacatattatattaacatgtactcatggatatttattttatactttgggttataatccaatgtactttcattatcttgtgctcaggttgtccggctttggctattgggagctcttgcagcagtgtttttttcacaaatctccatcattgatggggtggcagttggaacagggatttttggtaagaggagagtgaaaaagttggctaaaattcaacattcagaaaactaagatcatggcatctggtcccatcacttcatggcaaatagatggggaaacagtggaaacagtgtcagactttatttttctgggctccagaatcattgcagatggtgaatgaagccatgaaattaaaagatgcttactccttggaaggaaagttatgaccaacctagacagcatattcaaaagcagagatattactttgccaacaaaggtccgtctagtcaaggctatggtttttccagtggtcatgtatggatgtgagagttgaactgtgaagaaggctgagcgccgaagaattgatgcttttgaactgtggtgttggagaagactcttgagagtcccttggactgcaaggaggtccaaccagtccatcctaaaggagatcagtcctgggtgttctttggaagggctgatgctaaagctgaaactccaatactttggccacctgatgcgaacagttgactcattggaaaagactctgatgctgggagagattgggggcaggaggagatggggacaacagaggatgagatggttggatggcatcaccggctcgagggacatgggtttgggtggaccctgggagttggtgatggacggggaggcctggagtgctgcagttcgtgggatcgcaaagagtcagacacgactgagcaacttcacttaacagtgtccaccatagaaagcaatgatagatatctcagaaatgtttctgcactgatagaagaggcctcagtcagctgctgggatttaggcagaaagggtaacccggcgagctgcagtccatggggtcgcaaagagttggacacgactgagcaactgaacagcagatgtgttgggttggggaggggtcatagcgtctttactgggtgccttgaaaatccagagtgttacaaaaagcactctttcatcctttctttcccattcttacattgtctttgtcattttaacaactgccctcctccacccctccaaattcttttatgacttttcttgcttgaggtcttttttcttcaagtttctaaattaccagcctccctctgggcaccaaacaaaatggaaagaaagcatctgtaaaaggccctcgggagcacaatgaaggagtttaggtctctgccctctgtcctggaatatttctgatcacttaacaaaggtacaatgagagtcaacaaaggagaaatttctttattccaaaccaaaagtcatgaagcacgtgggcttaatgtgggctcaaggaaagtaggaagtgggtaggagggaaaaaaacagaaacgatgactctgtcttcaagatttacaacacataaaaaagttagagaacaaagccatgtttccactggtgcccaacataacactttacactccagataagttcacctctgcttcctgttttctcctcattgtgcttattatagcagttagcatgtggtcagctagaggcaatgaaaacctaggggttacttttttcatatattaagaaacccagagggaaagtcttgctgcccttcagttcagttcagttcagtcgctcagtcgtgtcagactctttgcgaccccatgaatcgcagcacgccaggcctcggagttcacccggactcacgtccatcgagtcagtgatgccatccagccatctcatcctctgttgtcctcttctcctcttgcccccaatccctcccagcatcagagtcttttctttttttttttttttaattttattttatttttaaactttacaatattgtattagttttaccaaatatcaaaatgaatccgccacaggtatacacgtgctccccatcctgaaccctcctccctcctccctccccacaccatccctctgggtcgtcccagtgcaccagccccaagcatccagtatcgcgcattgaacctggactggcatctcgtttcatacatgatattttacatgtttcaatgccattctcccaaatcctcctaccctctccctctcccacagagtccataagactgttctatacatcagtgtctcttctgctgtctcatacacagggttattgttaccatctttctaaattccttatatatgcgttagtatactgtattggtgtttttccttctggcttacttcactctgtataataggctccagtttcatccacctcattagaactgattcaaatgtattctttttaatggctgagtaatactccattgtgtatatgtaccacagctttcttatccattcatctgctgatggacatctaggttgcttccatgtcctggctattataaacagtgcttcgatgaacattggggtacacgtgtctctttcccttctggtttcctcagtgtgtatgcccagcagtgggattgctggatcataaggcagttctatttccagttttttaaggaatctccacactgttctccatagtggctgtactagtttgcattcccaccaacagtgtaagagggttcccttttctccacaccctctccagcatttattatttgtagacttttggatcgcagccattctgactggtgtgaaatggtacctcatagtggttttgatttgcatttctctgataatgagtgatgttgagcatcttttcatgtgtttgttagccatctgtatgtcttctttggagaaatgtctatttagttctttggcccattttttgattgggtcatttatttttctggagttgagctgtaggagttgcttgtatatttttgagattagttgtttgtcagttgcttcatttgctattattttctcccattctgaaggctgtcttttcaccttgctaatagtttcctttgatgtgcagaagcttttaaggttaattaggtcccatttgtttatttttgcttttatttccaatattctgggaggtgggtcatagaggatcctgctgtgatgtatgtcagagagtgttttgcctatgttctcctctaggagttttatagtttctggtcttatgtttagatctttaatccgtttagtcaactcttcgcatgaggtggccaaagtactggagtttcagctttagcatcattccttccaaagaaatcccagggctgatctcctttagaatggactggttggatctccttgcagtccaagggactctcaagtcttctccaacaccacagttcaaaagcatcagttcttcagcgctcagccttcttagttcagctcattaagaacacagctctttctactctgccgctccccattggtttgctttttgtgtctgttgcttcatggtcataagacagctgccacagcacctgcattcatggctgctttcaaagtcaggatgcagtgaggcagccagatagagagggctgatcttcctgccatccatcaagggactcaaaatacttttttacaagccttttcaacagacttgccctttgtctgactaaccaacttggtcacaagaccctttacgggctgtagcaaaaatgagtgcctagcaaacagtttaacttaaccatcattgctttaaaaccaatcacaatttattcgtaagagctgggcacattgctaccctcaacaacaacaacaaaaaaagcagagaaatggcaggtaaccaggtctgccaagcccatccacgcatgtgccttgcatcctgttcacctcatctgtagaggcttcactgacctcctcctcttacttagaatcagttcatacttcaagaccccagctgactgtcctctctttagggcacaccaagcacctacagccccaccccaagaggagggctcaagctgagccaggcctctggcccagtgttgtcgttctgacttccctgtccttcactatctcctggagtactcatgtccattgagtcgatgatgccatccaaccatctcatcctctcttgcccccttctcttcctgccctcaatctttcccagcatcagagtattttccaatgagtcgactcttcaacatcaggtgaccaaagtattggagcttcagcttcagcatcagtccttccaataaacattcagggttgatctcctttacgatggactggttggatctccttgcagtccaagggactttcaagagtcttctccagcaccacagttcagtggaagagtctgatttcctgggtttgaattcttagccaagcctctttctagttttggcctttagaaattgttttgaccctccaggagtgaggacgtttcagttttcgtatgtgtccaaagaacacgcgtagagggactggcccaaagctagctgtcttcagtttttaaaaacggattgggtggatggctggatcatatctaccttcatagaatcactgagaagattaaacgagaggacatatatgaaaaaactgaatgactcctggcacatagtaaatgtttattagacacaggcaaaaaccaatcctattgctcagttcagttcagtcactcagtcatgtccgactctttgcgagcccatggactgcagcacgccaggcctccctgtccatcaccaactcccagagcttacccaaactcatgtccatcaagtcagtgatgccatccaaccatctcatcctctgtcatccccttctcccgccttcaatctttcccagcatcagggtcttttcagatgagtcagttattcacatcaggtggccaaagtattggagtttcagcttcaacatcagtccttccaatgaacactcaggactgatctcctttaggagggactggttggatctccttgcagtccaatggactcaagaatcttctccaacaccacagttcaaaagcatcaattcttcagtgctcagctttctttatagtccaactctcactccatacatgaccactggaaaaaccatagccttgggtagacagacctttgttggcaaagtaatgtctctgctttttaatatcctatcactatcttgcttcaaaattttcagttgcttcagtcacccttatggaaaaggatcaagtccaacctgtttatgcaatctggcctctgctacctttgggactcagctgtttcctgcttgtggctccattgaccctgtcacttaccagcacacctgcttctcccacccattcatccctgccctggtccaggactttcttcctcctgggaccatcctctctgctcctcttacaagccaggccaggtaagtttcccagaacaacaggaagttggaacatctgagaactcactcaaggaagacttttcagagctggccagcaagaaagcatcctctcagatctgcaccgccaagaccaccttacttagtatttgactagtatgtgagtgtgggaattcccttgtagctcagtcggtaaagaatctgcctgcagaatcactgcagtgccagagacctggcttcaatccctgggttgggaagatcccttggacaaggaaatggcaacccactccagtattcttgcctggaaaatcccatggacagaggagcctggtgggctaagtccatggggtctgaagagtcagacatgacttagcaactaaaccacaagaccccaggctaaactccagagaagttctgtgtctgggaaggagtgggaagcagggctgcaactcagatcgtgataccctgcacagtgtggaactgtttatacagaggagcgtcttcctcaaggaaccaagcccatagaacttggaaagaccccacaattacccagaatctacaacatgccaagaattacaggtgcaatctcccgagattcctcatttagtaatgaagtattttcttatattcctatgtatatacgcagggcttccctgatagctcagttggtaaagaatccgcctgcaatgtgggagacctgggttcaattcctgggttgggaagaccccctggagaagggaaaggctacccactccagtattctggcatggagaattccatggactgtatagtccatggggtcgcagagagtccgacacgactgagcaactttcactttcactatgtatatatgcaaggttaacctgttcaccttttctttcttccagctccttctcgcccactctatctctgcccacgcctgtgccaccgcccatcctcccaggcatctttcctcctccccgagtttctgtgggatggtggttttacacctgtcacaccacaccgcccctccaccgccccactgcgcatgctcagatcccgctcccactcctccaggctctgtacctcgagcccgcccccacccctccattcattcctgcctgcagagcccagaccccttcgtaagccaccgctttcacactctcagtggcctgctgagccaccttcactggctccccagcgtcttccttcggtgcagacgtctgacctgaacctctggatcctgcagccagtgcccaggtgcctttcagtccatctctcatgtggcctccacttccccccttttcctttatttagaaacatgtcatacattccggagtgctcctaagagatgtccgagttgctcttacagagatcacatctgtgtaaccaccattcacggtaagactcgaggggtacttagcagccgctggacggccactcacctctctgctccccagtctccgcccccaatcacccattcctctcctgactccaagagttgaccctctcctgacagaggatgagatggctggatggcatcactgactcgatggacgtgagtctgagtgaactccgggagttggtgattgacagggaagcctggctgctgggattcatggggtcgcagagtccgacacgactcagcgactgaactggactgaactgaactgacatctgcagaagcattcccttgaattctttacaagtttgccacctattcctaaatgccgtatttattgtgctatgacttttgaatggtctttttctaagatacaattcatataccatgcagttcatccacttaaagtgtgaaattcaatggtattagtatatttaagtatatttaagtttagtatatttagttatatttaagttaaccatcatctcaatctaattttagaaaacgttatcatcccaaagagaagccctgccccccaaccctcgactgcccgtaatcaactttctatctttatagacttgcctattttaggctatttcatatgaaaggaattatgcccattcgcccccgccctccttttttttggcatgtgggatcctaggtctccacccagggatggaacccacacccctgcagtggatgggcggagtcttagccacgggccaccagggaggcccctcacttggccttttccacactctgtgctctcagagaactgggcccctttgctcccctcttgggcagaaggagtgcttcttcgttctgtctggagagcctccctgcccattgctacccagccaggagtgtcagtttctgcaggacccaaccccaggcctctctgccatgaagccattcttcttttccaccccaccctgggtggtgcttccctcatcaaattctcaaaatactctgcaagtccgtttgtctaggagggcagggagtccactgtctccccatcagcctgtcggccctgggaaggctgagggccttgctggctcggctctctgttggtccccagagccagctccaagcctagcatgtggcaggtgtccagtgggtgtgtttgcggagagagtgagggacatgcgtgtcagtctcagatcatcgtcctgtgtgtgtgtgtgcgcgcacacactcagctgtgtccaacgctgcatcccccatggactgcagcccgccagcctcctccatccatgggattctccaggcaagaatacaggagtgggttgccatggcctcctccaggggatcttcctgacccagggatcgaacctgcatctcttgtgtctcctacgttggcattcgggttgtttatcaccagggaagcccagatcatcatcatgcatgcgtataaccagttctccagagagacgttcgtgagataaatcaggagtgatgttttctttccctgacctgctctgtggttggctctgctctgtgttggctcgtctcctgctcccagatgaaatctcaggtagtcctaatgcttcctgctcactctccgaagatgaattcccaatgtccactgcattcaggagtccaatatccatttcaaagttaaaactcctgcctggttcagttgaggtttcctctggccggcacgtggaagcaagtggttggtttcttcactccttccctcaccttgctggccgcaccttgacctctccaaggtcagaatcaagaggaggcagaggtaaacagcctctggccacggccccgtgtgacacccgctctgtctctgagcctctgtcctggcccccaccccccagactggggatatttcctgcccgtcacgccctcacctcaggcaaaagcatctcatctcgttctttacctaagagccttggtctctggaaacctagcagtacctctcgattcccctgctgctcttagaattctccagtacagtcccacagaggtctctatcacgtggtacacccctgctctgcagtgaacttgcatctttgtctcatggtcattggaagtgtgggcacacagccgtcttctctgtggcttcagccagccccttacctgtgagaatccacatgcccgaatctgactctggtccctgagttacctaagttccctgggcagtgagcaacctttccaaaaggcatcactgaagctagccttatagaccaaggaaagaagatagcatcccaccgtccttccgtggagagataaagctcattgcacaagacctgtttcttttctaagaaaccctctctgtaatctccagcccctctctcagctttgctgatgttttgtacaggcttcagcttgactataaacaaaggtccatatagtcaaagctatgatttttccagtagtcatgtatggatgtgagagatggacaataaaaaaagttgagtgccaaagaatagatacctttgaactgtggtgctggagaagacttttgagagccaggagatcaaaccagtcggtcctaaaggaaatcagtcctgaatattcattggaaggactgatgatactgaagatactttggccacctgatgcaaagagctgactcatttgaaaagaccctgatgctggaaaagattgaaggcaggagaaggggatgacagaggatgaggtggttgaatgatatcactaactcgatggacatgagtttgaacaaagttcaggaaatagcgcaggacagggaagcctggtgtgctgcagtccatggggtcacagagtcggacatgactgagccactgaataacgataataggtatcagctgaagggctcaaagtttgtttccaacaacctcctttgccatcctgcctggaaaccacacacctcactttggaatgtgattgttctcgccacgtactaacttgggaccttggtcaaaaatgagactccgcccttttggggggcggctgtgtagggtcttagttgcgacatgtaggatcttttgctgtggcactcagcactcaggtttagttgccttgtggcaggtgggatcttagttccccaaccaaggattgaacccaagactcctgaattggaaggtgggttcttaaccactggaccaccagggaactccccaagggtccccttgggttgtcccaagacatcccatacttgtcttatccttgaatgagactgttcgctcctggaagcaggcactctgctcatctcatctgttctcatctccattccctaccccgcttacctggtgcttggcagtgccacactcaaggtgctgggaggtattttagagaagagtcactgaggtgatgagccagcagcacgatggagcatggaagaagaaaagcaagaagaggccagtgctggggtgaggactcaaagggaaggctttagaagtttcgttttagaagttactcaggcttggaatctatttttcaatgaaatcagagatcttgctggcccagctgcctctggcactgagtcaaaagcaagtctgtagtgtaagtaacgtcatacagcatggccttgcgatgctgagcacgcacaaaatgggaacgctgagctttaagagggaacagaggtgcactctcactggatctggttccctccagtgatttttctagataatcttgttcctgaacatcagatctatcacccagggtttctttgggatattaggaaacatattggtccatttgtttagccctaggaaaggtatgtgctcgatcttgggcacataaaaaggcagaaattataagcaggagaaggagttctaggataagacacaaaaagtgtccaactcttagtctcatcctgggtgctgtactgagaactgggtctcattactctgcaatcagggtctctgttaacatgctaaacttaagtgggttatgctcatttgttttttgggtatttattgacactaggtttggagaaacctgtcctttcctctaaattccctgcctgcatgtcagccatcagccctttctctaaaggtctagaaatgtccccaaattatgactcacctctcctcccctcgttggaatctaccatccaaataccttcccaatctaccaccacctctctatccccaccatggcccccaatcaggtcttcaccatcatccactgagtggacttgtacaaaagagctttacagggcttccctagcggcacagtggatcagaatccgcctgccagtgcaggggaccaggttctatccctggtccgggaagagtccacatgccacagagcaactgaagcctgcacgctgtgactactgaagctggcactctagaatgcaagctccacaacaggagagcactgcaaccagatgcctgtacaccacagccggggagtagagccccccaccccagctggagagaaaagccccccaccacagccggggagtagagcctacccaccacagccggggagtagagccccccaccacagctggagagaagagctcccccaccaacagctggggagtagagccccccaccacagctggagagtagagccccgaccacagccggggagtaaagcccccccaccacagctggagagaagggccccccaccacagctggagagtagagccccgaccacagccggggagtagagccccccccccacagctggagattagagccccccaccacagctggagagtagagccccaaccacagccgaggagtagagcccccccaccacagctggagagaagggccccccaccacagctggagagaagagctcccccacaaacagctgtggagtagagccccccatcacagctggagattagagccccccaccacagctggggaatagagccccccccaccacagctggggagtagagccccccaccacaactggggagtagagccccccaccacaactgggcagagcccacgacaggcaatgaagagccccttgtgctgcaacaaagacccagggcagcaaaaagtaaatgagaaagaaaagaagaagcgataatggagtgcttctctctctctctctatcaccctccctgcctctttctttccctctgtttccctccccaccccttcttctccctccttcccttaccccgatcctgccatgtatgacacgacaagaaagcagccatctaccgatcaggaaaagaactctcaccagcaaccaaattgaccagcaccctgcctccagaacagtgaaaaaaaaaagttcatatctggcgtttaagccgtcaagtgtatagtttttggcagcccaagctgacaaaaacacctgggtggctgaatgttgcagaggcgacctccccctgttttaaccaaggactccgccgcagacctgtgggtggtttccttatgcgaccgctgtctgacaccccgtctcgggcgatccccatctatctcgtgttcctgacactgatgagctctcttgggtccttagagcttttccaggtgtatagtattgtctgagctgtagcacctttcaaaccactttctcccttaggggcttcataattgcatctgacttttactcaaaagtatgccttttattttttccaccctggaaattccttgggcctctcttttgccaagagcctgtttgtgtaaatcaaccttcccagtcccctccctcccttgtccaaggtctttgccagtatcaccggattatagtcagattattctgtcctagggcttctcagatggtgctagtggtaaagaacctgcctgccaatgcgggagacgtaagagatgcgggttccatccctgggtcagaaagatccccaggaagagggcatggcaacccactccagtattcttgcctggagaatcccatggacagaggcgcctggcagcggggttggagtgggggcggaatgggttacagtccatgaggtcacaaagagttggaaacaattgaagcaactcagcacgcatgcatgcagagagatggtacctcacacaaaacttaaacccagcctgactgccttcctccatgcaaacccagggctctccacattcttctctagttatgtaattgtaattcccacaagctttttcctaaaatgtttgtaatactgtaccttcaagcacagataactcttaataacttacatttgtttaaacatacatgaaactggaatagaaatataacccacctgggattcaggcacttcatttcggggctggccatcacctccccctacacgtaagcagataaacctgttgtgtcaacagagaaaacgcttggcaaagaactgaaattttctcaccagtatcactgacatttcagtaagcctttcccaacccaccttcccactcgcctcacaaaggagtctgagagcttgggagaagctgcaggacagtgaactgggtctttgcttactttctctggggtcaaggagcctacagatgggtgatagagtgagcctggatcacctaagggggaagaaattcaactgaattgaggtttggaggtgtagcgggggaggagaacatgggttctacaactgtggcttcagcactagagccactggccacacgccactgtttaaactgacattaatttaagtgaactaaaagagaaaataccacccttttagccccactaagcacatttgagtgctaaacgatcacctatgctgctgctaagtcgcttcagtagtgtccgactctgtgcgaccccatagacggcagcccaccaggctccactgtccctgggattctccaggcaagaacactggagtgggttgccatttccttctccaatgcatgaaagtgaaaagtgaaagtgaagtcgctcagtcgtgttcgactcttagtgaccccatggactgcagcctaccaggctcctctacccatgggattttccaggcaagagtactggagtggggtgccattgccttctccaagcgatcacccatagtggctaccatattggacagggcaggtatagaatatttccaacattgtggcaagtgctattgggcagccagagcatacaatgtaagtaatgcctataaggaaaaccaaacgcaaagttcctatcgctgaaatgagtgttgggacactttcctggtagctcagactctgtgctcccactgcagagggcaccaggttaatcccaggtctgggaactaagatccccataggccttgcagggcagtccaaaaaaatgtgttggaaaaacatgaagtggacttgggtgactgcgttaagagtaaaatataatttttttaaaaaggcgttcttaggttttctgtccacaatggtgaaagatataactgtaaatagaatggaacctttaaaaagtgcataaaatattaaaagttttttaaaaacaaaaaatgttagggtttccctggtggctcaatggttaaaaaaaaaaaaaatctacatcccaatgcaagagacatggattcaacccctgatctgggacgatcccaaatgccacagagcaactaagcccgtacaccacgtctactgagcccaagcacgctggagcccatgctccgcaacgagagaagccactaaaatgagaagctcccgcgctccgcaactaggaagtagccctcactcaccgcaactagagaaaagcccacgaagcaaagaagacccagcacaggcaatattaaatttattatttttttaaagaagttttttttttttttttttttaataatgaaagtaagagatgaaaggcagggagaagaaaggaagatagtcagatggttatgaacactaaggtgtctcactgcagatcaagagaacccattatccccatagcacaggaaacccagtgtccaggggccaatttgtctgaagcctcatctggaagtgacaggcacttccccatctgaagacacagtttcaaaagtgtgaccgtacaggcatggtcatgggccattcgagtgtttgatgtggcttttgaaaaccctagtatgagggattggactataaagaaagctgagcaccggagaattgatccttttgaactgtggtgttagagaagactcttgagagtcccttgaactgcaaggagatccaaccagtccatcctaaaggagatcagtcctgggtgttcattggaaggactgatgttgaagctgaaactccaatactttggccacctgatgtgaagagcttactcatttgaaaagaccaatatcgggaaagattgagggcagggggagaaggggatgacaaaggatgagatggctggatggcatcactgacttgatggacatgggtttgggtggactccaggagttggtgatagacagggaggtctggtgtgctgcggttcatggggtcacagagtcggacacaactgagcgactgaactgaactgaactgagtatgatggaggaagataatgtcatctttaaatagctcccaaaccctgcttacacatcacttccttttcttaaggccatattagatgcctcgccagttgtgcaataacctatgtgggtgccaccgctggggaaaaagaaacacccacaggcaaaggagctcactgcacttgtttaagatgccaggaaagaaaccccaagaatctgtaatcgcaaggagtcttgggggtcagatttgggctcatgacagtgagcagcccctgtgttccgggctcctttaacctcccagctcatctatctgggtttttcagcctttgttctgtttagcaaagctccatccccttcactgtcaagcagctattgtccattctaccgccatactgatttttcgagactccttaacagcaatcctccaagagtccccttgacttcagggctctgtaaagtctaaagaaaatcagctttgctgactcctcactctgtttgccctctctggtggtccggccaagaatggaattatccaacaagctctggaactgggcaggcaggaccactcatgtgtgcttttttattcatgaaatcctcgccaagtgtggggcctcgaagagcaattcctactctactgcttagcaacaatggctgggtgaaccacttctaggagttccacaggttggcaggatgtcttaagaccagttattgttagtagtgaaacccggctctaatcccgtctgcctctcactctgaccaggagagaggcactgacggagaggcaagcccaggcctggaaaccagccccgctcccagcctgggctctgcgcctgcgtgcaccctccttccctcccctcccccagcatctcagcaaagcaaggagcaggggcacgtgtctgcacattcaggggctggcaaacttgttcaccgcccgaggtccagagtataaccatcaactctcagggatctttcaagaaggcacacacacataccacactcatatttgcacccattccccaagcacacctgtacatacatacatgatcatatacacatgtacacacacatatgtatgtaaacacattctacacctgcacacatatacagaacaaacttgcacacatatatatacacatgcatatgtgcatacatgcaacatacacccttacacacatgaaaacaacatataccctcacacatacgtgcacacaacacatgcacacaactacatacatacgtgcttttgagagttcagccactgccagcactactttgcttggctaaccaagctttgagctgcccaggaataggaagcaggctcaggaagtgggaccccaactcaccgtttccctttagaagcagctctggaaagggtggggggagcggtacctttcccacttctgtctcatcccagaggcattaggaaccagcttggactcagggcagagcgtgggctgtcatgcagtgttttcggctgtactgtggcatcaactccatctctcattataggacctgcattatctactgatagagtgtcgtatggtctatgatattacatgtatataacaatatataagaaagattaaaggatgtctatgaacaggtcaaccagaggagaggcagggaggagaaattctctctccaacaggaagtggacagcctacttagaaattgaccccgcagtaagtcagacacagagagacaaatcatatgtgatatcatatgatgtcacttacatggaatctaaaaaaaaaggatacaaatgaacttatttacaaaatagaagtagagtcgcagatgtagaagacaaacttatgtttaccggaggataagggagggagggataaattgggagactggattgacatatacacagtactatatacataaaatagatagctaataaggacctactgtatagcacagggaatcctactcagtactttgttgtggcctatatgggagaagaatcttcaaaaaagagtggatatgtgggtatgtataactgatgcactttgctgcacacctgaaactaacaaaacactgtaaatcaatcgtgtttgtgcatgtgtgtctgtctgttagtcactcagtcgtgtccaactctctgcaaccccatggactgggctggatgaagcacaagctggaatcaagattgcaggggaaaatatcaataacctcagatacacagatgacaccacccttaggtcagaaactgaagaagaactaaagagcctcttgattaaagtgaaagaggagagtgaaaacgttggcttaaaattcaacattcaaaaaacaaagatcatggcaacaggtcctatcacttcatgataaatagatggggaaacagtggaaacagtgacagactttattttcttgggctccaaaatcactgcagatgatgactgcagccatgaaattaaaagaagcttgctccttggaggaaaagctatgaccaaactagatagcatattaaaaagcagagatgttacttggtcaacaaaggtctgtctagtcaaggctatggtttttccagtagtcatgtatggatgtgagagttggactataaagaaagctgagcaccgaagaattgttacttttgaactgtggtattgaagaagactcttgagagtcccttggactgcaaggagatcaagccagtccatccttaaagagaccagtcctgaatattcattggaaggactgatgctgaagctgaaactccaacactttggccacctgatgcgaagagctgactcatttgaaaagactctgatgctgggaaagattgagggcaggaggagaaggggacaacagaggatgagatggttggatgatgtcaccaacttgataaacatgagtttgtgcaagctctgggagttggtgatgggcagggaatcctggcatgctgcagtccatgggtcacaaagagtcagacacaactgagtgattgaactgaactggactgtagccctccaggctcctctgtccatgggattctccaggcaagaacactggagtgggttgccattcccttctccagaaatcttcccaacccagggactgaacctgggtctcctgcattgcagggagattcttttactgtctgagccaccagggaagccctaaatcaatcatactccaattaaaaaaaaaagtttcaatgtaataataaaaaaagaaaagaaattggcctgttgtccgccagtgatgccagctgggccctgggctgtttttatgtaatccctttcacacacaggtcaggccttgtagcctcttctattccactgagtgtctcaagctaaaatctgcaggaatccagtgatttcaaaggaatggagaaaaaaatgggatgaaagggcagaaatgtgaatcttgaaaggtggcgctcactggctaatgatacctgggtttcaggctctgctgtgtgcgctctgagttttctgcaaacatgagctaatcagcctgttctcagaggtgggtgcgcatgtgaattgttaccattcaagcttgcagaaccacttagctctgtcacacttcttgtagcaacatgccaagtaaaaacacccggggtttaaaatacctggatctgagctgatagagctggggaatctgtgaaggcacttgtgaatttgaattagaattttccctcttctctcctagctcttggccactgtacatccttccagactgtgatgtccattcagttgtctccctcctccccaaagggggcttccccaactaggcttgcttgaaaatcaagccttctccataatgaccaactgtcctggtttgcccaagactatctcagttttaacactgcaaatcccatgtcccaggaaactcattagtcctgggcaaactgggatggctggtcaccctgagactctcactaccctgcaggatgggtaacaggtgattttgctattaattatactgcatgctgtctaactgggacttccctggtggctcagtggtaaagaatccacctgtcaatgcaggagatgcatgttcgatccctgggtggggaagatgccctggagaaggaaatggcaatctactccagtattcttgcctggagaactccatgggcagaggagcctggcgggctacagtccctggggtcataaaagagtcaaacatgacttagttactaaacaaccacagcaacaacactgtctagtaatacaacctactgattcacaagctgagtttgtcccaggtgctcaaataaagtgttttttttctttattttttaactatttatttctttggctgcactgggtcttggttgtggcatgcagactctttgttacatcacgtggaatcttccatcacagcacatggactctctctctagctgtggcatatgggctctggcactcacaggctcagtagttgtggcacctggggttagttgctgggcagcatcacttagttccctggccagggatcgaaccactgcacggcagatccttaccactggaccaccagggaagccctatcctttcctaatctccctggaacacctaatttgggcaccaagaatgggcatcttgatttcatttctttaaataacaagtctctactatgacatactacaaaataagactccccaaaggtttcacctctaatgacaacatggagcctccgcactaagaagtgtcttgagctatgagcctcaagattgaaggtccagaccaagaagattccagacctaaggattttgtcctgatttgtagaagagccctgaaaggtcaaccctctcggttggttccaactgttgtttaaatgcaggttcctataatccatcctcagaacttctggttcaaaattgggaaaggagtacatcaagattatatgttgtcacactgcttatttaacttctgtgcagagtacatcttgggaaatgccaggctggataaatcacaacctggaatcaagattgccaggagaaatgttaacaaccttagatatgcagatgacaccaatctaatggcagaaagcaaagaggaactaaacagcctcttgatgaaagtgaaagaggagagtgaaaaagctggctttaaaacttgaagaactaagtttatggcatccagtcccaccactttatggcaaatagatgaggaaaaaatggaaacagtgagacttcattttcttgggctccaaaatcactgaggacagtgactatagtcacaaaattaaaagatgcttgctccctggaagaaaagctatgacaaacttagacagcatataaaaagaagacatatcactttgtcaacaaaggtccatgtcatcaaagctatggtttttccagctgtcacgtacagatgtgagagttggaccataaagaaggcttagcactaaagaattgatgcttttgaactatggtgctgaagaagactcttgagagtcccttggactgcaaggagtcgaacaagtcaatcctaaaggaaatcaatcctgaatattcattgaaaggactgatgctgaagctaaagctccaatactttggccacctgatgtgaggagccgactcactagaaaagaccctgatgccgggaaagattgagagcaggagaagtgggcaacagaggatgagatggttggatagcataaccgactcaatggacatgagtttgagcaagctctgggagaagtgaaggacagggaagcctggcatgttgcaacccatggggtcgcaaagagtcagactcgactgggcagtggaacaacagcaatagctgattaacaatgttttgatagtttcaggtataaaccaaagtgattcagttttacgtatacgtttatctaatctttttcaaatttttttcccatttagcttattacagaatattgagcagatttctctgtgctatgccgtagttccttattggttatctatttttagatattgcagtgtgtacatgtcaatcccaaatccccagtctatccctcaccccacacattcccttccccccgtaaccgtaagttcatgctctaagtctatgagtaaaacaggacttttagactctgacaacttgagtaaaaatagagattatatttggtctggaagaaggttcacaagatcttattactgtgtttctaagtttccactaaagttcttcccttttggacggaaacctctttcttgttttgtgttttgttgttgttgttgggttttggggttattgttttaattttttggctgcactgcatggcatgtgggatcttagtactctgaccagggattgaattggaagccgggaattgtaaccactggatcgccagggaagtcccctcatttgatgtttttgtactagtttacactccttccctccattatctgacaacctggcttgacagctgaaggttttgctgcagagaagtgattagctgtcctcccgctcccagatccagagcctcagcacctgtccacctgcttctgcagggccttcagcacggacactgcttcctcagtgcttgtacatctccagggccctaaagttatcctcagaccttctgctgggactagaggtgtttgagggacaccatctaatatcaagtggcactagtggtaaagaatcgcctttcaatgccagagacacaagagatgcgggttcaatccctgagtcaggaagattcccgggaggaggaaacggcagccagctccggtatccttgcctagagaattctatggacagaggagcctggcacactacagcccacggggtttcaaagagtcagctacgactgagtgtgcacacacacacatctaataataccgcatcaaacatacaggtcatgacacctgaccaggaaccccaggacatctcaggcaatctcaagccatttcccccatcttttggaaacagccagataactactgagcgcagccaaggtgagttggctttgctcctttatttgagccaaattctcaagcaggtatttttgaagctctaaattccaggatctctttactatttctctaaggatatttggaatctcacacaaataggatttctgattacctctggtatcccagtatttccaggtagacagacaagttaggcctacatgatgaccctcacatgccatgagacaagctgggcagtcagttgtgaggcaaactgttttggttggccgtggacagtaccagttttagcactgacagtcttacaccctagaaaagtcctcaggcctgggaaaactaggacaactggtcacccaagcaatcagtcaaagtgaaaaaaaaaaaaaaaaaaagactgtctacaagttgagatcaactgcaaattaaggtacaatgattcagtgctcttagtgttggcacaagtaggggtttttttccccctctgtgtctacacacagtgcattttcttagatctgccaaaatgctgatgtaattaagtcccctctttgtcacagctttcctatgaaaatattcatagaagtcctggagccagctttattcaagccagttgattgcttagtgaagcattccctgcttagctgcttcaatcttctctcttctcatcattttagctgatctcttctgaactgctgccaatctgtctgcatcttcttggtgccatggtactcggaattgaacaccaggtatatgtatatagactctcacctcctcgtctcattagatgccttcggcaacaaatacaccacaaccaagtaagcatcttatccaattgttgtaattgcttttaggacacgtacacacagatggatattctgttaatcaagagaattaagcacctctgaaggtcaaaaaccacatctctcttggtgagaaaaggcagagcaataatcttggaacattgatgagcattacaataggaaaggaaagggatggagttctaagaatcttgttaaaggtccagttttgctggggaaccagctgggaaaccctggagaagtcacttcaccagcctggctctccatttcctcatgaatgaaaatgaagtgtttagagaggtcaccacaaaagtcctgaagtgctgtttgggaaaagacagatactacttcaaaataacatttcatccactggatctcagtgagggcagagctgaatcagttttgctaaatatacctgtttctccaacccactgcctgcctgccctccaaggcatgtcaacatttggagaaaggggaaagaggcatttccgctttacgaaagcttacctagaggtgatgcccgggactgtggtaggctaaataatgtccccctcttaatccctggaacccatgaatatgttaggttaggtggcaagaaggaattcagattcctgagtctcaagaatagaattaagaattaagaaggatagaattaagtttgccaatccactgagttttttcaatataaaatataaatttgggggaatataattggtttgggggggaatataattgcttttcaagcaatttctgctgtacagtgaagtgactcagctgtgcgcatgcccgtgtccctgccctgttggatcccggccactggccccacccctccatcgtcacagcaggctcccactggctctgcctcacgcgtggcagtgtatagatgtcagtgctgccctcagctcatcccagctctcctcccctgctgtgtccacgtgccggctcttgtcctcagctgaccttaaggtaaattatcctggataatccaagtggacctgatggaatcacaaggattcttaaaagtggaagaagggtggaaaaacaggtcagagtatttgacgtgagaaggcccccgcctgccatttctggctttggagacggaagaagggtcgcagaccaagaaatgggggcggcctctggagactggaaaaggcaaggggtggagtccccctcctagagtctcccgaaggaacaccttgattttaggtcatttgagaactcacttaggagcgctgaccttcagaaatagaagagaatacatttgtgttgtttcaagccactgcatgcaactcatcttgttacacctgcaaggcacaacagttacagggacctctagggccaagtgcagacacgtacactcactctcacatagaaacacacactctcacacacattcacacacacacacgtggtcacactcacatacgtattcccaccaacccacactctctctcatacacacactcatgtacactctctcacacgctcacacacgctgacacacactcacattccacacacccccatgcactactcagtcactcacacactcatgcacatataccctaactcctcacaaacacactccctcacacatgctgtctcacaaatacacactcattcacacacatactcacacacttgtcctgaagaatgaattcattcaactgccctggactctctggaataacacctgtggacttttcagtgtccccaggagaacattttaatttctcttaaccatcgtgctcatttgcttgtgctccatcagttaaccatgtctgactcttttcgaccccatggaccaaagcccgctgggctcctctgtccatgcgatttccaagtcaagaatactggagtgggttgccatttccttctccaaggaatcttgctgacccagggatcgaacccgaaactcctgcatttttttaaccatgcaatgtgttagtcactcagtcatgtcccattatttgcaatcccatggactgtagcccaataggctcttctgttcatggaattctccaggcaagaatgctggagtgggttgccatttccttctccaggggatcttcctgacccagggatcgaacccatgtctcctgctttgcaggcagattgtttactgcctgagccaccagggaagcccttttaaccatacaagaaataacttgcagtgaaacaagctatgggacttgaggggttctggctacccttatttccaccagcctcactcttggtgactatacacggcccaacccacacttcccagggggaaactctctttcctccgacttccactccagccccactcccaacttcaccacctcccagccctgccttaccaatctccctctctgggcctgaaatcagttccctactttctgtaccactcagcacagcaaactgttagattatgaggataaccagtcataagactggtgtatagcactctccctgctcctctcctccctgactcctccctcctccaagatgcacttgacatgctcttccttaaacaccaggatctgattttttttttaatttgcttaaactccccaggcatttagtgcacaacttagtactgcagttgggggcacttgttggagttggtggagggctgatctgatggggaaagtactgggcatggagtcaaggggctacaggctagtcccggctcacaccattattctgtggtctcttaattacaaaatatgtcactcttcaccaaataaattagattgctggtctctaaaccccacatgaaatgtgtcattatgggtgtgtttacattcagttggaatgttctgagtcccccagaaattacaagttcctttggggcattatttgagcttctatttatttttaattcagctccacagctagtaaaatgtgccacaccctgtgagagtccagtaaatgtgggttgattgactgctggcctcaaaggaagaaagtatgactcaattcaaatactgcaaatcctgaaccttttaggaaaggaaactgctctgtgggcatgcatttggatcttcttcacatcaccagtgacattttgggaatctatgtctaaatgtgtaaaacaacttttagcatgctataaaataattattagcatcattgtagcttcgggctgtaattacgtttttatagcagaaagtatttcacgtgtgaaaattagaccttattttatttagaaggcaagtgttatgggctaaattgtgaccgcttcttcatggatcaccggagaaggaaatggcaccccactccagtactcttgcctggaaaatcccatggatggaggagcctggtgggctgcagtccatggggttgctaagagtcggacacggctgagcaacttcatttttacttttcactttcatgcattggagaaggaaacagcaacccactcgagtgttcttgcctagagaatcccagggatgggggagcctggtgggctgccatctatggggtcgcagtgtcggacacgactgaagcgacttagcttagcttagcttcatggatcacagcattgtcatggcgaaggggcttgtgtaactcagcaaagctgagccatgctatgcagggccacacatgatggacgtgtcatagtggagagttctgacaaaacgtggtccactggaggaggaaatggaaaaccactcctatattcttaccacaaaaaccccacggacagtatgacttggaaggactgatgctgaagctgaagctccagtactttggccacctgatgcgaagaactgactcattggaaaagaccctggtcctgggaaagattgaaggcaaaaggagacagggaccacaaaggatgagacagttcgtagcactgactcaatagatgtgaaactgaaaaaactctgggaactagcagaggacagaggggcgtcgtgtgctgcagtccatggggtcacaaagagtcagacttgacttagtgactgaacaaattcatgtgctgaaggcctgatccccaggacctcaaagtgcgactgtacttagatataaggtctttaaagaggtagttaagttgaaatcagatcattagagtggccctaactcagtatgagcggtgtcttcacaggaagatgagattaggacacagacacatacggaggcaggaccacgtgaagacacagggagaagacaggtttctataagccaaggagaaaagactcagaaaaaaccaaccttgctgataccttgatctcagacttccagcctccaggaccgtgagaaaattaatttctattaagctacaagtctgtggtacatttttacggcaaccctagcaatcgaatatagcaagtatacagatgaattttgtttattttagatgtttgtggaaagtatattcactttgaaattgcatacttaatacctgattgttgtaaaaagttttggaaacagaaaagagaatgggaatttgatgaaacttcagtttcaccctcccccccactggtgcatatccttccaaagcttcttaaaaaagaaaaacatacacatataaatatataaaagtttttgaagtggataatacacagtctataaccaactttttcacaaaatatacgtcacttttgctctaccattttaataaacataaatttaactttaacgcttgtgtagttcgccagtatacaaagatgtatcataactcaagcaggcctctgttgcttaacagctagactttttcctggtttttactctcatctgatgatctcatctgatgagagtaaaaaccagctagactttttttcttggtttagagtaaaaaccagctagactttttcccaggttttactgagagtaaaagttgattacagactgccaaagaatgctcaaactaccgcacaattgcacttatctcacacgctagtcaagtaatgcttaaaattctccaagccaggcttcagcaatacgtgaaccgtgaacttccagatgttcaagctggttttagaaaaggcagacgaaccagagatcaaattgccaacacccactggatcatcgaaaaagcaagagannnnnnnnnnnnnnnnnnnnnnnnnnnnnnnnnnnnnnnnnnnnnnnnnncttctatgcagagcacatcatgagaaatgctgggctggaggaagcacaagctggaatcaagattgctgggagaaatatcagtaacgtcagatatgcagatgacaccacccttatggcagaaagtgaagaagaactaaagagcctcttgatgaaagtgaaagaggagagtgaaaaagttggcttaaagctcaagattcagaaaacgaagatcatggcatctggtcccatcacttcatggcaaatagatggggaaacaatggaaacagtgtcagactttatttttctgggctccaaaatcactgcagatggtgactgcagccatgaaattaaaagacgcttactccttggaaggaaagttatgtccaacctagacagcatattcaaaagcagagacataactgtgccaacaaaggtccgtctagtcaaggctatggtttttccaatggtcatgtatggatgtgagagttggactgtgaagaaagcggagtgccaaagaattgatgcttttgaactgtggtgttggagaagactcttgagagtcccttggactgcaaggagatccaaccagtctattctgaaggagatcagccctgggatttctttggaaggactgatgctaaagctgaaactccagtactttggccacctcatgtgaagagttgactcattgggaaagaccctaatgctgggagggattgagggcaggaggagaaggggatgacagaggatgagatggctggatggcatcaccgactcgatggacacgagtttgagtgaactccgggagttggtgatggacagggaggcctggtgtgctgtgattcatggggtcgcaaagagtcagacacgaataagtgactgaactgaactgaactgactctcgtctgataaatgacgcatacctgttcagccatctttgcattttcctattggttcccataggataaatagctaggagatagttgtatcaaaaaggaatgcagttttcagactttttttttagtttttgcctgttttagaattttttaatatttatttatttggctgcgacaggtcttcgttgtgacttgggggatctagttccctgaccaggaatcaaacctgggccccctgcattgggtgtttggagccttcccactggaccaacagcaaagtcctgttttccagacttttgatactttttttaaggaattcattttgttctccgccttatcccccatacctcaaacaaggctcagcacaaaatacaggcaaatcaatatatgttgaattaattaattttgccaaacaaagtagattcactcttgacatgccatttctttttttttgtttgtttccatggaaaaaaccctcttgtttatttgattaaacaaaaataaaataagctgcataggaacaattttaaagtccaaagagacaccagctttgttttaaggctgcagtagctgatacatcatctccttgctaccttgtccagcctcctctgtggaccacagcaatacattcagaagcctgttagctaacacaggagtttttgaacactttcccatttataactcttttaagattccaggatgattcatgtctatgtctggcaaaaaccaccacaatattgaaaagtaattatcctccaattaaaataagttaatttttaaaaataactaaatacatctattttgagattctataaaattaaaagttgtttaaagacccagaattcacggctggtcagagactggtagaaatgagggtccattggtgccttcaaactcatcggggagtcttagctggcatctgagccagagaaacatctctcctaggggatgttctcaaaaatctattcttttggcaaggtatggacttggaaagagtggaaatgtatgggctcaaatcagttgtcacaattagaaaaaaaacaataagctacaaacacatacacatatgcatacgcaccccacccaagctcagcttactgcaaggccagcacgtaattcctcggcgaagcccgttcaggctgctgtaacgaaacaccatagactgagtggcttatacatgatagaaatgttccccacagttccggagggtgaaaactccaagcccaaagtgcccgctgatgcagtgtctggtgaacctgctttctagctatctttccactgtaacctcacaggacttgaaaagtgagagagctctgtggggtcccttttataggaacactaataccatcatgggggctctacccttgtgacctaaatacctcccaaaggatctgctttctaatgccatcatatgaggattaggttttaacatatgaattcttgggtggcacatttaactcattgcaaccccctcttcaacagagataagaaaagcaaccctttgtctataccagtaagttatcctcatattaaatattccactcatctatttcactgtcctgaaagccgcagatagcacgggcaacccacatcttcataaatgctcatgcttgcctacaagagaagacatcagtaaatctgatgtgaagatgcttgccttccatgtattaaaactccaggaacaggagagttaatactgcagactaaaatgggtgtgttgggacttctctggccatccagagacaactcagcacctccactgcagggcgcacgggtttgatccctggtcggagaactaagatcctgcaggctttgctttgcagccaaataaataaataaatgaaatgggtgtgttgcactggcaacttaaatcccatgagagtgttgccatcagtgatgggattctcagaaatggtgacagttgttggtaatgctctcacaagagaatgtgatgttttttcaatttacatggttacccaaataggattcattgcatattcagttcagttcagtcgctcagtcgtgtctgattctttgcgaccccatgaactgcagcatgccaggcctccccgtccatcaccaactcccaagatccacccaaactcatgtccctcgagtcagtgatgccatccaaccatctcatcctctgttgtccccttctcctcctgctctcaatctttcccagtatcagggtcttttcaaatgagtcagctcttcgcatcaggtggccaaagtgttggagtttcagcttcagcatcagtccttccaatgaacacctaggactgatctcctttaggatggactggttggatctccttgcagtccaagggactctcaagagtcttctccaacaccacagttcaaaagcatcaattcttcggcactcagctttctttatagtccaactctcacatccatacatgaccactggaaaaaccatagccttgactagacagacctttgttggcaaagtaatgtctctgcttttgaatatgctatctaggttggtcataacttttcttccaaggagtaagcatcttttaatttcatggctgcagtcaccatctgcagtgattttggagccccccaaaataaagtctgacactgtttccactatttccccatctatttgccataaagtgatgggaccagatgccatgatcttagttttctgaatcttgagctttaagccaatttttccactctcctctttcactttcatcaagaggctgtatagttcttcttcactttctgccataagggtggtgtcatctgcatatctgaggttattgatatttctcccagcaattttgagtccagcttgtgcttcctccagcccagcgtttctcatgatgtactctgcatagaagttaaataaccatggggacaatatacagcctcaatgtactccttttcctatttggaaccagtcggttgttccatgtccagttctaactgttgcttcctgacctgcataagaggtttcttaagaggcaggtcaggtggtctggtattcccatctctttcagaattttccacagtttagtgtgatccacacagtcaaaggccttgtcatagtcaataaagcagaaataggtgtttttctggaactttcttgctttttcgatgatccagtggatgttggcaatttgatctctggttcctctgccttttctaaaaccagcttgaacatctggaagttcacggttcacgtatcgctgaagcctggcttggagaattttaagcattacttgactagcatgtgagatgagtgcaattgtgtggtagtctgagcattctttggcattgcctttctttgggactggaatgaaaacaccttttccagtcctgtggtcactgctgagttttccaaatttgctggtatattgagtgcagcactttcacagcatcatctttcaggatttgaaatggctcaactggaattccatcacctccactcgcttcgttcatagtgatgcttcctaaggcccacttgacttcacattccaggatgtctggctctaggtcagtgatcacaccatagtgattatctgggtggtgaagatcttttttatatattaaaagtgtgtaaaaaataatttgcattgcatataatgtggaattcaggtctatgagttgatcactatccacaaatttttcacctatgcgaatgatcaacaaaatattcaaaaataatgcaggctgggggccagttcttcattttgaaggaaacctcactctttgcagggtggctagcaatccaggcatctacctactaagtgccaggtatgtccttagtcattgtgactacaaattcccacaaagatatgaagaaattggaaccattgtgcattgctagtgagaaagcaccatggcagttgcttggaaaacaaaacaaaacatagaattaccatatgcactagcaatatatatatatctgaatatatatccaaagtaactgaaagtagaatctcaaacatatttatatggccacattcatagcagcagcattcacaacagtcaaaaagtggaaataatctacgtgtctacctaccaaggaacagataaacaacacatggtatatacctgcagtgaacatgcatttaccctgcttttaaaaaggaatgaaattctgatccaagctacagcatgggtgaaccttgaaaaaatcatgctaagggcaacaagccattcacaaaatgacaagcactgtatgactccacgtccatgaggcatctgaagtaggcaaagactgtgggagcagatcgcggggttaaagtttaagggacacagaccttcagtttgagaagataaaagttctggagatgatagtggtgtcggttgtaccacactgagtacttagtgctgctgaactgtacacttacaagtgcagttgcttggaaaacaaaacaaaacttagaattaccatatgcaccagcaattgtacttctgaatatatatccaaaataattgcatagctcaactggaattccatcacctccactagctttgttcgtaaattttgtataacgtgtgttttaccacacacataaaaacgaaagacaaaagacagtgatgacagaaaaaaaataaaataacagcggaaaaaaaaaagtcttgcacatttccaaaacactgcaagagtggaactgccctgttaagcatcactgcacaaacacgcttcttaaaatagaggcccaaacgctgtactttgaacagggagtgataaaagtgtggagaacatttcagggataccaaattggttttctctcaagtgccattgattgctggaagttgactgaagtgctgtgttgagaaggcacccagcctgcctctgaactcggcaaggaagagcacctcagtctatgagctgtgccttccgagggcaagagacggggacaagggtggccccgtgtcacatgtgtgcaggctgagaaacgtaaaccctcttgctctggacttcttctgcctgcaactaaagactaaatcgaaatagctttttggcaggaaaaaagtgcaattgacatatcagattccatttccccatattttgtaaaacatttcagaatctacagcaaagagggaaacactgggttcaaatacaggaagtctcctccatagaagcctccaagtcgcaagctttcaaggtgagcttgggcccatgtgtagtgtgccagttgtggtaatgttgttattttagcccctaagtaatgtcagactcttcatggactgtagcacaccgggcccctctgtccatgggattctctgggcaagaatcctggagtggattttcatttccttctccaggggatcttcccaacccagggatcgaatctgagtctcctgcactggcagccagagtctttgcctctgagccatcagggaagcccaatactactgtacatttcaaagtactggactgtaagattaaaaatgttttcttgggacttccctagtggcccagtggctaagactctgcgctcccaatgcaggtcccctggtttcaaatcctggtcagggaactagatcccacaggcagcaagagttcacacgctacaactaaagacccagtgcagacaaatgaataaataaatatattttttaaggtttctttatactttgcttgtttttcatgtattatttgggtgaaaagtattataaacctgtcatagtacagtcctatatgcacgactgtgttagttgagtaggtacctaggctaactttgttggacttgagaaaaaattggctttacgaacgcactctcaaaatggaactcatttgtatgtaggggacttaactgtattccaaaccatatgtatttaactcaatgagagaaactcactgtgaccaagaaataagaaaaaaaaaaaaaaaaagaactgctttagcagtctataaagcatggtttggggagctgtctagaggcatttatactcaggcaactccaaaatttaaaacatctagtaaaattcttccccgtattaactttgatcacattttccttccgtagtctgccctctggtgatgttactaggcagcgaactcatctgagattgaattgactgagggaaacggggagggtaaggagaaactaatcaaattctgcttgaagatcttctcacgacagagggaaaattccatggctgctcctgctgccaatgctggtgacgatgctggtggtgacagtggtggtggtgatggcattaatacctaatctttatacaaggtgagaatttagttgctcagtcccatccaattcttgtactcccacaggctgtaggctgccaggatcctcttgtccatgggatttcccaggcaaatatactggagtgggttgccatttcctattccagaggattttcctgacccacggatcaaacccagtctcctgaattgtaggcagattctttactgactgagccaccaggacttgctcccagagtgtgtccagttctttggactatagcccaccaggctcctctgtctatgtaatttcccaggcaagaaaactggagcaggtagacattcccttctccaggggatcttcccgacccagggatcgaacccaggcctcctgcattgcaggcaggttctttaccctctgagccaccttctggaggctctaatctatgtatactatttctctatgcctggttctattgcaaatgcgttacataactttcactagtttcatcattacaacgatcttatggggccggtactttgtgttacctactaacacatgaggaaactgaaacatagagaggtcatgtcacttgctgaagcaacacagctaataagcagaaagaagcttagaggctcctaatgtgcacacgttcctagtcactcagtcatgtccgactctttgtgaccccatgggctgcagcccgccaggctcctccatccaggggattctccaggcaaggattctagagtgggttgccatttccttctccaggggatcttcccaaccctgggattgaacccacatttcctgcatcagtagggggattctttaccactacaaagactacatattggttaaagttgtcactagaaataattaccatgaaggtttcaactgcctagtaattgtagcaggctcccaaataacaaatacacatatttaggaacaggcttagaagtgtttatgtgagtttatgtattcacctactatgttcttaataaaagggagaggggtggagttgggagggtagagaatactgtaaagttgcccttgggggagttgatttgtcatgattttctcagaatttggcatagtgtagatgttcagtggaggcgtgctaagtggcacagtagttaaaaatcctcctgccaatgcaagagactcgggttcaatttctgggtcaggaagatcccatggagtaagaagtggcaacccactccagtattcttgcctgggaaatgccatagacagagtctggcatgctacagtccatggggtcacaaaagagtcagacacatcttagtggctaaacaacgagtacatgaaatataccagagatacttctaaagtaagaattctgaaggctacaggtgttgcaaagagtcggacatgacacagtggctaagcatatgcacacatgtgcaaagaatgctttctgacaattaattaaaggaatgaacacatgaagggtttcccaggtggctcagtggtaaaggatttgcctgccaatgcaggagacttggattcagtccctgggtcaggaagatctggagaaggaaatggcaatccactccagtatgcttgactagaaaattccatggacagaggagcctggtgggctatagtccatggggtcacaaaagaatcagacacaacttagtggctaaacaacaacaatgaacaatgaaacataccagggatatttctaaagtaagaagtctggttgtacgttggtgatgtccctgtcagcctcttccagtttccctggataaaacatttatagtcatattttgcatgggttcctcgccccattctgaaatcattgcatctctgagtggatcagctatactaagggtttgtggatgacatttccattgtgcaatcacatatgactattgctctgatatggttaatatcaatgggtgggatttgaaagtagatgctttattagttaggggcacagtgtgatttgtaggtaatatcagctggtgataagtcattcatagagagttcaggcagggtgaaaaagaatgcctggctcacggcttcagattgggagatccaaagggcttctttgagcagatgccattcaagttgagaatcgggtgcatcaaggagatgatgaagatggggagccttcttgtgcagtatttacaggaagaaggtgtggcctggagtatgagaaggaatatataagaagatgagtctgcaaaggtaggagaggcatcaggtgggaacttctaagccagggaagggatctgggcttttgttttaagggctgtgggaaagtttaggtgggtgatggtggattaagggagtggcatgctgtgacgttgcttccctggtggttcagacagtaaagagtctgcctgcaatgtgggagacttgggttcaatccctgggtcaggaagatcccctggagaagggactggcaatccactccagtatacttgcttggagaatccagtggacagaggggcctggcaggctacagcctgtggggtgacaaagagtcggacacgactgagcgacatcattttcactttcacaatgcgactgtttttaaagaacactggctgtgtttgaggaattggttgaaaaggatgagctagggagcaggggaaccacaaggaaggttcctggcagaagtccaggccagcaatcatggcggcttcgctaggtcagaagcagagagggtgaaagaaggagggcatggtggggatgttccccaggaaagtgggcaggaccttttctgggattagaggaagaggagacagaacagactcaaggatttgatttttggcctgatcagctcaggccaaatgataatggtgtcgttcatggaaatgggaagactggggatggagtaattggttatttttcttttggaagtggagaaggatcaagagtttatttcagccccattaattttaaaatgcctatttgacatcggggaggaattccaagcaggactttggagattcaggcctggaattctggcgaggggtcaggcccagagaagcagtggagcaccccgtgcgtgtcggtaacacacgcacatctgcacaacatctgccagctctcagagcctctgtgtgttattagcttttaacctcatagctgtctcatgacaaggttattacttctggaactttactgattaataataatacctggcctgtatatcttccttgagagtttcctaaacacttccccatagactgtccctgtcacactttgctcctattaatcacactgggaaatagaaggcctgggcaatggtggctgtaaagacaggaattacacctgtcggaacttatacctgcagaggcaacagatgatgtcatagggtgtgcacacctgtgtgttgtttcgttcagcggctaaatcctgtccgactctttgtgactccgtgaactgcaggcagctcaccaggcttcccggtccttcactatctcctggagtttgctcaaactcacgtcccttgagtcgataatgccatccaaccatctcatcctctgttgcccctgtctcctttggccctcaatctttcccagcattagggtcttttccaatgaatgggctctttgcatcaggtggtcaaagtattggagcttcagcttcagcatcaattctttcaatgaatatttagtgttgactggtttgatctccttgctgtccaagagacacttatgcgtagcctctttaaaaaagcagttagttttttgtgatggacatgagagccctctgctgtttagactgggcatatccactagactgatttttttcagctgaatggactggaagtccattattgaatcagagttctctcttatttttgtaatatgctcttgggacagaaaccccacatgatgaccattaacaatatttaaaacaatttaaattgtcatagctaataatatccctgtggtataaaaccccatattttatttttcaagaaagcaatgttgaatgagagaaacaaaaagctttatgtttgagacaaatttttttccactgccagttacccaaatccaggtactgttctagaataaaagcagcaatttcatggctaaaagaggaatgaaaagcaccaaaacctttagaatatctgctatataggactgccacgtgaaatcagtaattgcatatttcaaaaaaaaatgagaaatctggtcatatttacctgtatattttatcaatacatgggtagagtggcatctaaaggatgtagatgtataggattggccaaaacgttcattcgggttttgctataagatggtacggaaaacctgaataaaagttttggccagcccagtataaacggaagggtatgaattctccttggtgaggttggaggttgcagaaacaagtggtgaacagatgctggacagaagaaataccctgaaaccaagagaatgttagacgcttgggctgggacataaaactggacaagaaccccagctgggccgactgagggtcttcagcatcacctgggtttgaccttccctgagttgatggttgttgctgttcagtcactcagtcatgtcctactcttcacgaccctatggactgcagcatgccaggcttccctgtcctgcactatttccaggagttgacggtagggaccccagaatgctcattagctggacagtgacattcatgatcaggtttgagctttaacagaggttttgaaagatgcatgtaaggcattcagaggcaggaaaaggcaggattaaaaacagccctttgggcagctcttgaatctatcaggaacttccatggtggtccagtggttaacactgagctctcactgctgggggcgcgagttccatccttggtccaggaactgagatccctgcgtgctgtgctgtgggccaagaggaaaaaaaaaaaaaatcaaggaaatcacaagctccttagccagggtagtgataatgggaaaaaggaagcagaataaaattgagatgaaggaaggaaaaaagagaaaagatggttgggagaatggaagaacattgtataaactattacaaaaaagacttagaaaataatttccatttttatcaacaacaacaaatatcatgtccttctcaggtctacctctatagactccatcttctcactcctagggctaactggcttgttttcccaggctcacagctgtccctagtcctaggaccccaagacctagtctaaccctacactgagcctattgaactattaactgagagcattaccaccctgtcagggaacatttgaaaatgcatgagaacatttttaattcatgaaatgacctagggtggttactgacatttaggaataggagatgttaaacatcctgaaatattcaaggaaggcctgcgctatacagagttgacccatgtgtaatccagtagtcccatcactgagaaacactgccacgccacccccactgctgaatctcagtttgatgaacaggcatgtgctgtgttctctggagcatctctcagaagatgggacgtatccagagacctctgaacacaaagctttaacacccaattcctgttataaacatttgatattctcccaaaatcactctatttccagttttttaaggaatctccacactgttctccatagtggctgtactagtttgcattcccaccaacagtgtaaaagagttcccttttctccagcaatcccactgctgggcatacacactgaggaaaccagaagggaaagagacacgtgtaccccaatgttcatcacagcactgtttataatagccaggacatggaagcaacctagatgcccatcagcagatgaatggataagaaagctatggtacatatacacaatggagtattactcagccattaaaaagaatacatttgaatcagttctaatgagatggatgaaactggaacctattatacagagtgaagtaagccagaaagaaaaacaccaatacagtatactaacgcatatatatggaatttagaaagttggtaacaataaccctgtgtacgagacagcaaaagagacaccgatgtatagatcagtcttatggactctgtgggagagggagagggtggggagatttgggagaatagcattgaaacatgtataatatcatgtatgaaacgagtcgccagtccaggttcgatgcacggtattggatgcttggggctgatgcactgggacgacccagagggagggtaggggaggagggaggagggttcaggatggggaacgcgggtacacctgtggcggattcatttcgatatttggcaaaactaatacaatattgtaaagtttaaaaataaaataaaatttaaaaaaaataaaggtcaaaagagaaaaaaaaaatcactctagtcactaccttttttctctgtattttgagaagttaacaagtgcctagcactgtagtcacagctggtggcctagacaagcagaaagataacccacaataaccgcactggctcagcggtaaagaatctgcctgcaatgcaggagatgcaggttcaacccctggagaaggaaatggcaacccacttcagtattcttgtctgggaaattccatggaagcctggcagacttcagtctatggggtcgcaaagagctggacatgacttactgactaaacagtaagaaaaacaagcccaaaatgtagtccctgcccacaagaatttaatactccactgaggaataaaaggctagcctacaagagaaattcttaaagcaaactggcttggtgtgtatctgtatataaaacagagctaaggttcctaatacaaaccaggattgtaaggttcagagaagaaaggacaaaataaaagctggaaaagcagagggatgattaggttagtgctcgtctatatttcccaaagtcggttccttggagcactggtccagtggaatagcaaatattgttactgggagaaaaaagtttccggggttttaaaagtttggaaattgctaggctgagcaaagttaatcagccaggaccccttagattgtctaataactgataactgctgtaattccctgggattgggctttcctcttcaaagtttgctccatttatttgaccgtggcacactctctctctctttttttaaagcgaggatttcatggtcccgggtccattgcatgttctcggaaaacatcaaagcacccgacatgtgaaggcacgggtgggaaagggaacacatatgaaacagtgagaagatgggcacaagcaacaaggaggggaaagctgggggtgaggggctggaggtgggggtgtggaatcagcgacacttaaactctgacatcagactgtaaagcttctaacctctggcatctcctagccacctgaacttcagcacgttacttcatctctctgggcctcagcttcctcacacagaaactgtggttgatcacagcatttgtcttgtagagttcttttttttgttgttgttgttttgcaatgcttttattttacagttttgccaaacaacagcctttcacgaagtatttcgagggagcggcagaagaggaggagagacatggcgggcaaaaaagctcagctcgcttttctgctccagcagcacacattcacagtgggacctcagttttcttgggtttttttcccccgccattcacttaaatgatatatttgaaagaatatacatacaaagaaagaacttgtagagttcttgtcaggattaaacatagtaaaacaatggaaagcacttgggattctccctggcttaaagtgatggtattgtacactgatgtaataaggctggaggggtcaaactgtgaatggcctttaaattggacagagaaaagtagatgatatggaaatgatagtctcatagaggtagtttatttgtatatttttctagtactattaataaatatttcatacaaaataaagaatatatgttatgtatatgtcgggtgtgtgtgtgcacagcagatgcaagatttaaagattcaaacaacttaagaaattgaacatcacccatgtagtggaaaccctcaccaacctctccccagtctctctcgttccctccccatcgaagggaaccaccaatctgatttggaagtttaactacaggcatgttcctctctatatattgcttagtttactgattagtgaacattatatcaatgtaaccaggttgtacttatttttctgtgacattctttttccattcaacttcatgtttcgaagatccatccataatgatacatcagctcaagttcatgtatctttgctgctctttcctgccgtggtccattgaatgaacatagcctgcacttttccatccattctcttctcaatgaacatttgggttaatacctattttttcccctaacaaaaatgttgacaagggcattcttatgcctgtttcctgtcggacctgtgtgagagcatctggatggcaatatgcctccaacttttctagatgatcccaaattgctttctgaaataatgaaatggactccctgccctgcccccctgccagttgaatatacaaattccttttcttcacatcacttatcctgcagactttgggcatgggtctgaccacacaaaactgtgtttaggaaatttgtctggcagtgacaagagggggcaaggggagaagcccttggtacaatgaatacgaaagcagagatgtcaaagatgcatcatggacctagcaagaagcaggcttttcagggggcagaatgcctatactgtgtgtgtgtgtgtgtgtgtgtgtgtgtgtgtgtgagttggtatccactgaaaagctcatgacccttaaatgtgcctaactgtctgcatggcctgtagaaaaagcaaataattaaaaactggaaattctaatatatttcctggctctggtgaaaagcatctggccccaagacttccctggtggtacagtggatgggagttcgcctgcccatgcaggagacataggttcgatccttggtccaggaagagtccacatgccatggagcaacgaagcccatgagccacaactactgtagctcgagcacctagcacctgtgctttgcaacaagagaagccacgaccgtgagaagcctgcacgtcacagcaaagcccccactcgccgcaacaacagaaagcctatgcacagcaacgaagactcagtgcagccaaaaataaataagtaaataattttttaaaaaagcatctggccccagggaagagactttgcatcttcagatctcatcctcctcgtctctaaactggacgtctttatctgccctggagaattgtcacaaggcataagaactagtgaatggcaaagagctcttggcacctatcaatccagatgtcagtgagtttagtagtagaaacaggtgatgccatgacattgacattcattaggttagaagtgagattgaacatgattgctccaaatagtgcttcccagcatgactctcactaaattgtaaacaagttaggtttgtctcaacaggactttccccaaaccattagtttccttggcctcctgcacaaataaacaggatagtcccaagaggtaggcaggtttcctgagaggtcacatcttcctgggtaggtcagccctgcaacaggaaagccaaggtctcatcttcatcagtcttctaatcttgcttaacccaggacccacaagaccaaaatgtatccctctggctgccttctgcctcccgtgttgaaaaaaagtcctgaccctctgccctaggtgactgaaagaattgtaacagtaaccctcttctcatcagaaaataaaatgtgctgcaaagccattcttataaatcatgaggggtccagatgcagaaaactgaggcaggtagatgttctgacacagccagaacacctggctgttgcttttggagctgcagtgaacctttcatttgtgaaccactgcagagcaaaaatgaggaccaagattgtgactgcatgctcaaggaaagctggaccaggaggctcactgcagtggtgtttgtatgttcaaaaccaccaggaacaatctaaacatcagtacagaaacagaaaaaaaaattttggtatgtccataggacagaattctagaaagcaatagaaagacattagctagatccttctctctctctctctgtctctctctctctctctctgtgattggctctcaaaaatgtagtattggggcttccctggtggttcagtggtaaagaatccgcttgccaatgcaggagacacgggttcgatccctgatccaggaagatcccacatgccgcagagcaactgaacctgagtgccacaactactgattctgtgccctagagcctgggagccaccactactgagcctatgtgccaccactactgaagctagtgtgccctagagccggagctccgaaacaggagaagccaccacagtgagaagtccacacaccaaactagagagtagcccctgctcaccacaactagagagaagcccacgtggcaacaaagacccagcacagccaaagtgaaagtgaaagtcattcagtcgtgtccgactctttgcaaccccgtggactatacagtgcatggaattctccaggccagaatatggagtgggtagcctttcccttctccaggggatcttcccaacccagacatcgaaccaggtctcctgcattgcaggcagattctttacgagctgagccacaagggaagcccaagaatactggagtgggtagcctatcccttctcctgcggatcttcctgacccaggaatccaaccagggtcttctgcattgcaggcagattctttaccaactgagctatcatatataaataaaattatataaaaaaatttagtattgagtgaaagcacatttctaaatgaacatccaatatagtatattatgttttataaacatataaaataatgttatattttgttcatggagaacatatataaaagtatacaatacatatttttaatgggccagaggatacttggcaaatttataccacagattatcttagaaagaggagaggatgcagggactggtgacggatcaatgggacctctattcaacctgcaaaattttgtttctttgatatatatatatgtgtgtgtgtgtgtgtgtgtacactaagttgcttcagtcgtgtctgactctttgtgaccctgtggactatagcccaccaagctcttctgtccataggcttctccaggaaagaataccagagtgggttgtcatgtcctcctccaggggatcttccagacccaggggtcgaactcacagttctgacgactcctgcattggcaggcgggttctttaccactagtgccaccagggaagccccatgcatgcgtgcatgcatgcatcctaagtcacttcagttgtgtgtccaactctttgcaaccctatggactgtagccctccaggctcctctgtccatggaaatcaccatagtcaaagtgaagtcactcagtcgtgtccgactctctgcgaccccatggactgtagcctaccaggctcctccatccatggaattttccaggcaagagtactggagtaggttgccatttccagaggatcttcccaacccagggatcaaacccaggtctcccgcattgtaggcagaagttttaccatctgagcctccagggaaaccccaggaagcaccatatatacgtatatatatataaaaccaggcaaataagttatagttaaccatagttcatcctgatggtgagagaagaggggcaggcgaaggagagacaggaataaggagtcaaccactttcgtttggcaaacaaaccacaaggagccccttcctaccctccccgctgccctgtgaaggaagaggaacctgcgctccctaccccacggcctccctgcctaacacccaggcgggatgctcgacgcagcttccactccatttctgcactggctgaaaagcctggtttctaccatctccctcctcgaggccacagacgccagccagccttggagcagggacacctgtggtgccagccggggggagcgacgtcgcaggacagacagacatgtcccgaaggccggggccacgccccttcctgggagcgcgagataataaaagctgacattttaccaatagaaaagaaaagagataaacctggattatcagacccagggcaaactgtagcctttgcgtcacacgcgggggtcacatgtgtggctgggtccactaacccggcgcggagggagattccctcagttgagctcaaccttggtcacgagagggtggtctcttcccattccgcccatctcttctcattaaaagagcccgagtctcaagtgtttgtcccacgttgttgggactgtgggaggctaaagaggtgtgtccttcctgctccccaccacccatgctctgttccagggactctgctttcccccacaccttgccctaacatccttcaagatcttaagcatccagatcattctttcattggggtcagcggtatccctttctgcttctatgcatcctgggggcaactgcagcagagaggaaggaaaatacacagaaaactgttttctctgttttgatggagatccctgctccctgcgcgttagctcagttgatccttccacacttctgggaggtgggttttgctatttttcccaggtgaggaaactggacttcgtccctatgatccctaaggaaaagttccatcttttcccttccttttcctccaagacaagtcttttgagctagaggattggggaagggagaaggaatacaggaggtgtgcaggggcgggaccaggggagtatttcaagtggggtgttgttaaaaactgcacctgtgttgtatatctgcagtgaacaggagaggaaaggaggattttgagagctacagtgattatgggtttcctggagttcaagaaatagatgaaacaaacttgagttacgttggtatgatttttggtgactgggactgtcttactacttggtggctgccctggtggctcagagggtaaagcgtctgcctaccatgcgggagacctaggttcgatccctgggttggaaagatcccctggagaaggaaatggcaacctactccagtactcttgcctggaaaatcccatgaatggaagaacctggtaggctacagtccatggggtcacagagagtcgagcacgactgagtgactccacttgatttcacttcaaactgtcgtattttgaagacaacaacatacagtagatgatctataagagtcatacctttataagctttgtagaaattaaatgagggtcagaatacgaccagaggcctctgggctctggaccatgtcctttccactgacactgggtgcctgtcccactgttctcacggctctgactcagacctggggcagctggattaaagagccgatcagttaatgcttcgcctctgatatcctgaggcctctggtgacttagccttagctatagcatcctctcttctggacccggaacctctgcctgcacctgaattgctctacttcctcctcacggccaccacttgaccagggaggagccatggaaccaggatggggtaaggaaatttctcaccaagactaggtaagcaaaaaaaaaaacaaaaaaaaacagaggaaaaagcagaatccagaaatacaaggaaaaggaacgaattaaggtcatttagagagatgtggatggacctagattctgtcatacaaagtaaagtaaatcagaaaaaaaccccacaaatctcatatgttaatgcatatatgaagaatcaagaaaaatggtaaagatgaacctatttccaaggcaagaagagagatgcagatgtagagaatggacatgtagactcgggagcgggggggaggtgagggaagggtgggacaaactgagaggttaggatcgacatcttagtatatatactaccatgcataaaatagctagctagtgagaacctgctgtaaagcacaggaagctcagcttgtgatgacctagatgggtgagattgggggggcaggtgtaggagaaggtacaaaagggaggggatacatgtatacatacagctgattccctttattgtatagcagaaacgaatgcaacactgtacaacaattatattacaattacaaaaagaaaaagaaacacttggaaataagaggccaaagatgacagaggggaatctgaggaaccagaggtggatcccaaatcttcagtcagttcagttcagttcagtcgctcagttgtgtccgactctgcaacccctggattgcagcacatcaggcctccctgtccatcaccaactcccggagcttactcatactcatgtccattgggtcggtgatgccatccaaccatctcatcctctgtcatccccttctcctcctgccttcaatctttcccagcatcagggtcttttcagatgagtcagttcttcgcatcaggtggccacagtattggagtttcagctatagcatcagtccttcctctgaatattcatgactaatctcctttaggacgggctggttggatctccttgcagtccaagggactctcaagagtcttctccaacaccacagttcaaaatcatcaattctttggtgctcagctttctttatagtccaactctcatatccatacatgaccactggaaaaaccacagctttgactagatggaccttctgataagcctagcatcctttcccccatccatctcttcattcattcatttgctcattcattcattcactctacaaatgtgtcaggctctgaactacgtcccgagggcaccatggagaaactcacaaagctcctgctccttgagatgctcacaggccagtggaggagacagacatcaaacagccccatttatagtacaaggtcaagtggtggtaagcgccacaaagcaaaataaatttgagcagggggacaaagaaagctgggagtgagactggctctttcagtgtgggtggtcagaaaatgtccctaagaaggtgacatggccacttggataagggagagggtgttccaggcagaggaaacagcatgagccaaggccctgtggcagcaccctgctaaggaaccctgagaaaccagtgttgttggcccacagggagcacaggcaagactggcagaaaacaagatgaagaaacagcaaagcttagaccagggagcctttgccagccagtataaggacggattcttttatgtttaagtgagacggtaatccatcgaagagttttatgtgggggggggcggtgtcataatctaacttttcttttaaaatatagtcctaacctggccacactcaagtcagcagtgctgtctttgagtcccagagccagagatctctgaaactaacccatttctcagccctccttcaaaattcaaatcttctttcctccttgtccagctatttgccccattttttcttgtgaggtgattcacacgtcttgcccccatagcctgccagctccaatatgcacttctacaacagttctatctttatatttgtcaatttccggccaggagccccagcaaaaattgtgagaagcatatttgcatctcacctgcatcagtagagcaaaaagggggcacaactgtaataaaaaatagttggaggtaggaagttccaaagctaccaaaaaaaaagggtgggggggggggggaggaatgatcccattgtaactaaatatagattccactgcagaccatgttgctgagatgcaaacttttacagacaatgtgcagttttgcttaagaccctttgcagtcactcttaagctgtacagcaaggtacccttagggaaagagccccacccattcattgccttacagatggggagcttgcagtagcttctgaccatcatcacaaggctgctgagtgtcaaggctcagctccaggctgggctcgtgacaaccaaccaaggcctctttcaacaacactatgaaagatttatgaaaggctgggcaacactaaaatgagcttatgcaacacttcccccaatgcaaattaagaaactgatttgaggaacagaaacttggttaaggcttgcctacctgcaaacagcaccgcagagaaagttgaatacttaaaaaagaagaaaatggtctctcaggggactgggagcattatttctgctctgaataactgagaagttgcgtgtgaaagagcttctacccaaattgagaaacttcaaaatctgacgttaagtttctccagtgttgttgtcgttgttgtttagtcactaagtcatgtccaactcttagcgacccgtggactttagtcctctaatctcctctgtccttgggatttcctaggcagaaatactggagtggattgccatttctttctctaggggatcttcctgacccagggatcgtgtctcctgcattggcaggcaggttctttactgctgagccaccagggaagctcaagtttctcctgtagactacaaaataaacaatatttgtagagcttcagttcagttcagttcagtcgcttaaaacacggtcatcctaaacatcccctcatttagtctttgcgataatcctgcaaggaggtgaaaatcagtatagttgttatccccattctaaaactgaggagactgaggctcagagaaattaaatgacttcctaaaaccaatcagctatgccttgaacatcaggccactgaattcttttcataagcagtagaagtttcagttgcgtacatgcctaccaagttactttagtcatgtccgaccctgcaaccctatggactcatctgtaaaacagggagaataatacctacatggtagctattgtgagaattaaatgaataaccgtataaaaagcaccagctcagggcctgacacaatgcagatctttgctattatttacagcttctttccattaatctcaatttacagcttttctagtcactctttggataacacatgattaaagacacaaatttgtttcagttgctcagtcatgtccaactctttgcaaccccatggactgcaggttgccaggcttccctggccttcaccatctcctgaagattgttcaaactcatgtccattgagttaatgatgccatccaaccacctcatcctctgacgcccccttctcctcctgccttcaatctttctcagcatcagggtcttttccaataagtcagaaagttgagaaaataatttaagtcctcagtgattcccatcattgccactcacacgccactgctgagaactaatcacatgactcgaccaggatgtagccctttactgggcagtcaccttccatagtggggaggcaggagcatgtggtcaactggtcacctctgtcactaccagaaaaaagcaaatatatcagttattacaacatccactggatcatagaaaaagcaagagagttccagaaaaacatctacttctgctttattgactatgccaaagcctttgactgtgtggatcacaataaactgtggaaaattctgaaaaagatgggaataccagaccacctgatctgcctctcgagaaacctatatgcaggtcaggaagcaaaagttagaactggacatggaacaacagacttgttccaaataggaaaagaagtatgtcaaggctgtatattgtccccctgcttatttaacttatatgcagagtacatcatgagaaacgctgggctgaaagaagcacaagctggaatcaagattgctgggagaaatatcaatcacctcagatatgcagatgacaccaccattatggcagaaagtgaagaggaactaaagagcctcttgatgaaagtgaaagaggagagtggaaaagtcggcttaaagctcaacattcagaaaactaagatcatagcatctggtcccatcacttcgtggaaaatagatggggaaacagtggaaacagtgtcagactttattttggggggctccaaaatcactgcagatggtgactgcagccatgaaattataagatgcttactccttggaaggaaagttatgaccaacctagacagcatattgaaaagcagagacattactttgccaacaaaggtccgtctagtcaaggctacggtttttccagtggtcatgtatggatgtgagagttggactgtgaagaaagctgagtgctgaagaattgatgcctttgaactgtggtgttggagaagactcttgagagtcccttggactgcaaggagatccagccagtccattctgaaggagatcagccctgggtttttttgggaaggactgatgctaaagctgaaactccagtactttggccacctcatgtgaagagttgactcattggaaaaaactctgatgctgggagggattgggggcaggaggagaaggggacgacagaggatgagatggctggatggcatcactgactcgatggacgtgagtctgagtgaactccgggagttggtgatggacagcgaggcctggcgtgctgcaattcatggggttgcaaagagtcggacacgactgagcgactgaactgaactgaactgataacacctaaggaaaaggacccaggaaagtcaaatataaagctatgggagaaaaaaagcagaaaaggcatgccaggtacacattcataatcattttgcacagaaagaaattcagaatgaaaatcactaagaatgtatcatagtcagaaaaacaccacctaccaaatatctcataaacctttctgaacctaaaaattttagcctcaaaatagataaagtaaaccctaatagtaatgtgaggagacactgacaagttcttataaagggtgactttaaacacatcttcagaaatcgctggccaattattacaaaaacaaataaggcttgagaagttctaactaatacaattaacaatgatcctttaatagatatctggagaggaataggtttttgcccaacagagattacacagtttttcaaaatctcttgagacattctccaggtacatcagttcacaaaagaacccataacaaaaccccaaaaggaaaactctgacagtccctattcatgaactataaggaaataaattagaaaataataacagaaaggaaaccaacaaaaattcatcctactggatattttacaatactctgccaactaagtcctgggaaaaaaactggaaatttagaatcacaggagcattatatacaaatcaaagccatggctttgacaaggcagcattctgagggaaaatatgtaaccttaaatacatataacagaaaaccagaaaggttgaaaatgaatgaatcaatcaagttttcaactcaagaagctgggaggagaggtgaggagaagagagatagaaaataaatctgaagaaagttgaagaaaaaaaccggggaagataaaagtagacaataataaataaaaaaaaaaaaaaaacaaagacaatagaattaacttgttctttggaagaattaatggaaagacaaacttttgacatacttgtctaaagacagaaaaaagacaaaatattaagtcaaaaattgtaaaaatgttaccctcatggcaagcattccgaaaaatctgtagataaaatgattaaattcctatggaaataacattataaaagttcatccaaagaaaggtaggaaacttgaatagaacatcaaccataaaagaaagtgaagagctattcagagatctacctaaaataggcatctattcagagggcttttcaggtagatactaccagacctttagagaaaattctataaaaactgtttccagggcctaggaaaagatgagaagctctgtaatcattttataagttcagtataacactgatacctctatttctctctccacatgtatatatggaatacatatggtatacacacacacacacacatatatataacatgtgtgtatatatatataaaacctttttaaaagatagaaaattccatatccaacagtgtattgaaggaataattagaaaaggatcattctaggaatgagaaggtgtttcaatattaagaatctaaggatttccctggtggtcgagtggctaagactgtgtgctcctaatgcaggaggcccaggacctaagacctctggtggctcagatggtaaagagcttgcctgcaatgcaggagacctgggttcgatccctgggttgggaagaagattccctggagaaggaaatggcaacccactccaatactcttgcctggaaaatcccatggacagaggagcctggcaggctacagtctattgggtcgaaaagagtcagatacaactgaacgacttcactttctttcaggatccatccttgatcagtaagctcaagtccacatgccacaactaaagattccttatgctgcaatgaagattgaagatcccccaagtagcaactaagacctggtagagccaaataaataaataaaaataaatatttttttaaataatcaaagaggttagagaaaccagatgattgtattaacaaatgtttcagaggcctttgttaaaattcagcactcattcttggcagcaaaccaggagaagacatgtcttaatcctgacaaagtgtgttagtaacctaagtaagtactattttgtgggtcaaagatcacaaatcccacccataaaaagtcagagataagacaagtttcctcttcagcgttgtgctgcaggtactaaataatacatcaagaccaggaaacatgaacaccattcactgacaagtctttcctttgagtcaatggaaacaatcctcagtatctgtttgcattttacagtttataaaagagttccatagacgctatctcctgtgaccctgacaaagtccaggtgagatgaggacaaggattgtcatcccagctttaaggatcatcccaggacaaggatcctgagagtcatggcattttgagatttccctaaagatatgggccaggtggcgctagtggtaaagaacccgcctgccaatgcaggagacatgagactcggttcgatccttgggtcgggaagatcccctggagagaggcatggcaagtcactccagtattcttacttggagaatcccatggacagaggagcctggcaggctacagcccatggggtcgcacagagtcagacacgactgaagtgacggagcacgcaaagatacagggatagctcagctggtaaagaatccacctgcaatgaggaagaccttggtttgatccctgggttgggaagatcccctggaggagggcatggcaaccctctctagtgttcttgcctggagaatccccatggacagaggagcctggcaggctgcagtctgtggagtcggaaagaatcggacacaactgagcgacccagcacagcacagcacaagcagtggtgaagcaatagaccccaaattttctgattctttatcaagttctttctcaatgccggggagactcagttaaaatataacggatctcattggtatcagtgactgacactggccaggtctctgtcctctgaacaagctgggagcaaactggggtgaagactggggggacactgcatggcgactaagttggaaggaagagagcgggtactgaggacaagcgttcttggtccctggtgtataaccctagatgctgtttgagaggtgatgctggccagtgcttccgagtacctgtctgtgtctatcatttaatcctcagaacgctcttgaagttggcattattaatattacttccattttacagatgacaatgctgagtcatctgtgctactcacctactcaccctagctgatagatagctagggtagtgccgggatttgaacccagcctggctccagtgtttgctcaaaatcactacagtagtgtctttaagccaataccttggttttggaagtaagatcagaaaccaacctgccatgcccatgtgctagatataaaaataatatcatcaaaaaataataataataataacatcaaagtatcaatttgctcattccatttttctgatattgctgaggccagaagggaaaatgttctaacgtacagtctgcttagaaacatcttattttattgagtatctgttttgtcacttcctaaaattagagctcggagaaggcaatggcaccccactccagtacttttgcctagaaaatccagtggatggaggagcctggtaggctgcagtccatggggtcgctagagtcggacacgactgaacgacttcactttcacttttcactttcatgcattggagaaggaaatggcaacccactccagtgttcttgcctggagaatcccagggatggggaagcctggtgggctgccgtctatggggtcgcacggagtcggacacgactgaagcaacttagcagcagcagcagcaaaattatagctagtccagagaaaggaaaccatatacccctcagtttgctcccttcagactacaacctgcacacggagtcttactcaataagaaccatgaaagaaaatcagaaaaaaaagtatttccctgttcggaccctataaagtgttattttaaagaattacccctccccccaaaaaaaagaaagaagaaaagagtgggtgtgggggattgaggggggaaaaagaattacctatgtaattataattcattgctctaagtttcttttattttttttaattgaagtacaattgatttacaatcttgtgttagtttctagtgtatagcaaagtgattcagttatacatacacacatatatgtataaatatatgtatatatacttttcaattataggttattataagatattgaatatagttcccaactcaaaacttcttttatttgcagctatactctcttatgtcaaagttacttgatgtctttcacatacccctaacctgggcttccctagtggctcagctggttaagaatccgccagcaatatgggaaacatgggttcgatccctgagttgggaagattccctggagaagggaacagctgcgcattccagtatcctggcctggagaactccatggactgtatagtccacggggttgcaaagagtcagacgtgcctgaatgactttcacgtcacttcaagctgcttctagaccttgttgcatctcccggagaaagcctgttagcacttaggtttagtctagtttttccctgagcacatatgtttattagcatagttagataatctcaactccatgttcacatggacctgctggaaattatccaagcagaactactttactttgcacaacctgttcatcctggaagaactttcccaaccaagcgacatactgtgcttcctttaaaaacttagttcacctcttacaggaagtcctccctgaagacattgcatgggctccagtaaaactcacacaacccaccacaatagtagctcccttagcactttccacattataagactttttgttaacttgtcagactctcacctgaaattgtaaaccctgtttgcaaagacaccgttcagatctatgtctattcagatctgtgtctccactgcctttggattaagaaataaattagtatttcagatttatcaatttgtcatgaaaatggaagatcattgctttcaaagatattaaatatgtattataatttaatagatatctataataaataattatttttaataaatagactttaatgttttaaattttcatatttattaaactttagaggtaacttagaaataacttataatgtctccaataaggacattatcaagaatgtttataaggaaataataaaacaatggtcccttgtcattagcaatgtatttggacacttccttaggagttttgtataaaaagcccataatctgtctcaataaatgagaattcagacagagattgagacagctactgtcttttaggtaataatatttctttaccaaagtaataagcaaagaaaaatatccaaagatatataggataaaaagaaaactttttgaatttatactttgcataggggtaggggaaagaaagaaagacttatgagtgattttgataaatggatggagggaagataaggtattaagttttacccagactgggatggaaataatgtcactttgcaaagaaatcaatgaaaatgtcatagatataagtacaaaatctgtcaatctgaatagtaacatactttaaagatttaggaagtgatgtccttgaattatacaatgacaggagttatgtctaggggagacagattcttagagtggcaggtattataggagaacatggggaaattttcagatgctttaaagacaaattgccaaaactgatctgtgaaaagcaattccactcaaagacccagatatgagataactctcacacagtcactgtctaatagatcactttaagctgcaaaaaacatcaggacatccggccatgaaaactggatctgtttatgcaggagacatatgtcatgggcctgaaactatttttccaagggagaaatcataatgaatttgatctgattcattcaaattttccctaaatctcttgtaggaacagatgtagaagacgaatatctgagattaagaggatgacaggcaatcataaatgagaactgctctgcttcaggaagtgtatgttagatgggggggaggggcaggggacagcccttgcaagacctagcctcccactctgctttaatctgatctcgggggagatgaatcactcctttgattgaaaggggaacctcagatcataagacatgtttgaagaaggaaatgaatctcctcaaatacagaaaagcaaaatccacaacttcttggcagcagagggtaggcaaagacaatctgcacttaatgtaataataaaaataatattaataattgtcttttgcgacataggaaaggtaggtgaacagttttatagggatcatttatatttgtaaaccaaaagaaacaagaaggaaacagttatcttttttgaatataaaaagtgtgagatttactctctcttaaagatcttaaaactccaaatatgaatctaaagaagatgcatctaaaatagaagtcaacaaacattttttgtaaaaggtcagataataaatattttaggctttgtgggctataaattctctgttataacttcaaaactctcccattatactgtgaagcagccataggtgatatgcaaatgaatgggtgaggctatgtttcaataaaactttatttgtaaaaacaaggagtgggccagatttggtccacagtatgcctatcccaatctaaaacattgttaaagaagtaacaaataacacactttcacataaatcatttttttatgtggttaatatcaagactacaaattaaagtatctgtaaaaaaattaaaaataaaataatagtatttgaggagaaatactcaaaataacaatggtgatgatgaaggtaataagaaagcaagaaaaaagcatgtctatttattattcaacaactgattatactgtgcttactaagtttcaggctctagcccaaatactttataaatattagctcatttaattcccaaaacacccctattattaccattattatctccatcttacagataaggaaactaagacataagaggctatcacttgcccaccagcaaaaagctagtaatcatgggaagacaacaaagtcaaattgaaaagactctcaaaggaatattattatcagaagactgaattaaaattctccttccacagctaactagcttgaccacataattagctggtgtgcactcctctccaagtacctaggaaagctgtggccataattctgccctccctttggactgcacagagttcctgcatctctcaaatacattggaaaggggttcattacttctctttgcttccacaaaatgttagtatcactactcagttatctaacaaatatatgtgtgtatgtgtatatatccatctagtatttacactagaactaaaattcatgaatgaccagcgggactattctcaaccttgcagaattcagacaagcataaaacttgtctcttcactgtcctgggctctataatgattttccacatatatgcataaatctgatactaacaacaattgttttgcagactagaaatctaaaatttagagaattaaattcacccgtataagttcatattaaaaaccagttccttggagaaattaacaataacacaataatagtgggagactttaataccccactcacacctatggatagatcaactaaacagaaaattaacaaggaaacacaaacgttaaatgatacaatagactagttagacctaattgatatctataggacatttcatcccccaaaaatgaattacacctttttctcaagcgcacatggaaccttctccaggatagatcacatgctgggccataaatctagccttggtaaattcaaaaaaatagaaatcattccaagcatcttttctgaccacaatgcagtaagattagatctcaattacaggagaaaaactattaaaaattccaacatatggaggctgaacaacaccctgctgaataaccaacaaatcacagaagaaatcaaaaaagaaatcaaaatttgcatagaaactaatgaaaatgaaaacacaacaactcaaaacctgtgggacactttaaaagcagtcctaaggggaaagttcatagcaatacaggcattcctaaagaaacaagaaaaaagtcaaataaataacctaaccctacacctaaagcaactagaaaaggaaaaaatgaagaaccccagggttagtagaaggaaagaaatcttaaaaattagggcagaaataaatgcaaaagaaacaaaagagaccatagcaaaaatcaacaaagccaaaagctggttctttgaaaggataaataaaattgacaaaccattagccagactcatcaagaaacaaagggagaaaaatcaaatcaataaaattagaaatgaaaatggagagatcacaacagacaacacagaaatacaaaggatcataagagactactatcaacaattatatgccaataaaatggacaacgtggaagaaatggacaaattcttagaaaagtacaactttccaaaactggaccaggaagaaatagaaaatcttaacagacccatcacaagcatggaaattgaaactgtaataaaaaatcttccagcaaacaaaagcccaggtccagacggcttcacagctgaattctaccaaaaatttagagaagagctaacacctatcctgctcaaactcttccagaaaattgcagaggaaggtaaacttccaaactcattctatgaggccaccatcaccctaataccaaaacctaacaaagatcccacaaaaaaagaaaactacaggccaatatcactgatgaacatagatgcaaaaatccttaacaaaattctagcaatcagaatccaacaacattaaaaagatcatacaccatgaccaagtgggctttatcccagggatgcaaggattcttcaatatccgcaaatcaatcaatgttatacaccacattaacaaattgaaaaacaaaaagcatatgattatctcaatagatgcagagaaagcctttgacaaaattcaacatccatttatgataagaactctccagaaagcaggaatagaaggagcatacctcaacataataaaagctatatatgacaaacccacagcaaacattatcctcaatggtgaaaaattgaaagcatttcctctaaagtcaggaacaagacaagggtgcccactttcaccattcctattcaacatagttttggaagttttggccacagcaatcagagcagaaaaagaaataaaaggaatccaaattggaaaagaagaagtaaaactctcactgtttgcagatgacatgatcctttacatagaaaaccctaaagactccaccagaaaattactagaactaatcaatgattatagtaaagttgcaggatataaaatcaacacacaaaaatcccttgcattcctatacactaataatgagaaaactgacagagaaattaaggaaacaattccattcaccattgcaacagaaagaataaaatacttaggaatatatctacctaaagaaactaaagacctatatatagaaaactataaaacactggtgaaagaaatcaaagaggacactaatagatggagaaatataccatgttcatggattggaagaataaatatagtgaaaatgagtatactacccaaagcaatttatagattcaatgcaatccctatcaagctaccaacggtattcttcacagagctagaacaaataatttcacaatttgtatggaaatacaaaaaacctgaatagccaaagctatcttgagaaagaagaatgaaactggaggaatcaacctacctgacttcaggctctattacaaagccacagttatcaagacagtatggtactggcacaaagacagaaatattgatcaatggaacaaaatagaaagcccagagataaatccacgcacctatggacaccttatctttgacaaaggaggcaagaatatacaatggattaaagacaatctctttaacaagtggtgctgggaaaactggtcaaccacttgtaaaagaatgaaactgaacactttctaacaccttacacaaaaataaactcaaaatggattaaagatctaaatgtaagaccagaaactataaaactcctagaggagaacataggcaaaacactctctgacatacatcacagcaggatcctctatgatccacctcccagaatattggaaataaaagcaaaaataaacaaatgggacctaattaaacttaaaagcttctgcacaacaaaggaaactattagcaaggtgaaaaggcagccttcagaatgggagaaaataatagcaaatgaagcaacggacaaacaactaatctcaaaaatacacaagcaactcctacagctcaactccagaaaaataaatgacccaatcaaaaaatgggccaaagaactaaatagacatttctccaaagaagacatacagatggctaacaaacacatgaaaagatgctcaacatcactcattatcagagaaatgcaaatcaaaaccactatgaggtaccatttcacgccagtcagaatggctgcgatccaaaagtctacaagcaataaatgctggagagggtgtgcagaaaagggaactctcttacactgttggtgggaatgcaaactagtacagccactatggagaacagtgtggagattccttaaaaaactggaaatagaactgccttatgatccagcaatcccactgctgggcatacacactgaggaaaccagaagggaaagagacaagtgtaccccaatgttcattgcagcactgtttataatagccaggacatggaagcaacctagatgcccatcagcagatgaatggataagaaagctgtggtacatatacacaatggagtattactcagccattaaaaagaatacatttgaatcagttctaatgagatggatgaaactggaacctattatacagagtgaagtaagccagaaagaaaaacaccaatacagtatactaacgcatatatatggaatttagaaagttggtaacaataaccctgtgtacgagactgcaaaagagacactgatgtatagatcagtcttatggactctgtgggagagggagagggtggggagatttgggagaatagcattgaaacatgtataatatcatgtatgaaacgagtcgccagtccaggttcgatgcacggtactggatgcttggggctggtgcactgggacgacccagagggagggtaggggagggaggagggaggagggttcaggatggggaacgcgggtacacctgtggcggattcatttcgatatttggcaaaactaatacaatattgtaaattttaaaaataaaattaaattaaaaaaaataaaaataaaaaccagttccttggattctttccaaggcttcataataataaagtagttcaaagtgagggaaatggcacagtgaggcctaaattgggtttattgttttacttgtttaagcattttcttaaatgtttaatagttcattctggaggatgcgattaagagctataaacacagattgtatattgaataaattaggatattttcaatcacaaataacagaaaacccaacacaaactggcttccataataagggaatatattggttttcataattccaagtccagaagtagattcagggttggtttaatccagcatcctgttcagttttcctgggattctcttggttctgctcctcagcctatggcagcttcattctcaggctggtatcaagatggttgcatacagaccaaatacagaagatgctactgtctttctgtcactttctggatcatgagaaactttcccctagaatcacctagaacatgtcatcttgcatcttttagactaaaatctgtcagatgcctattcctcagccaatctttgaggtcagaggaaccaccctgtgctaactggttttgctgttgttcagttgctcagtcatctccaactctttgtgactgcatggactgcagcactccaggcttccctgtccttcaccacctcccagggttggctcaaactcatgtccatgattcggtgatgcccgcttctcctgtatttctgaacaaatcactagcaagggggattacattgttgaatttgtctggataaagcccaggttacctttggagttgagattaatcttcttaacttcatagttgttagacaacagagggatgaaatggatcaggaaaagcatttgttgctgtttttggctgagcagctctgaacctccttcatatattggggataagaatctggatttatttctccagattataaatcctagtggagagcagattctaagtcccatcattaaaagtgaaaaacagattttgtcactcctcagatgcttatgtagctaggaggtgggcaaatgacctagatttagccaactggaccctttcccttccttcagccatccccagagagcgaatcaggagcaagtgacccaaagaagcagggccagaatagaatctgaatggtctgactagcagggctctttcgtcatggctaactgaccatggaatttctaaggtccaaaatcataaggagcccactcatgtctgacaaatcagaggaatttcaatagagagtctcaaatcttagacctgaagtagtttatagactcagagccttttgaatgaaggaactactgatgaataactacactttcattgttgtcattttagtcgctaagtcatgtccgattcttttgccaccccatggactgtagcccctcggggctcctttgtccatgggatttcccaggcaagaatactggagtggattgccattttcttctccaagggatcttcccaacccagggattgaaccttagtctcctgcattgacaggcagattctttaccactgtaccacctgggaagcccagatctacaataagatcataaatatgtattgaaaatcctcatcctgatcttcctctaaaacagttatcatcattagtcagggtaaacgtgtactaaagaaggggaagtacctagatcttcagaggattattacaaactggtccattattaatgctaattcctacggaaacagaatgccactgttgtctaccagagagaagattatgggcaataaggtaataaattgatttgtttgtcttcattaggctcaatgagcccccaaatctgtgttcatttcctcagcttatggagttataactggaactgatacatacagcaaagagcaattctccacattggctctctagtccatgaattaagggctattatgataggaatggtcaagtgcaaactctccatacataaaatagcacatcataagtgatatcacatccctagaagaatttcagagattaaaaggtctgaaagaccaaagatgatgattgctaccacattccgatttaactttctagattggtcagtgaagaaaaccaggtgggtcttagagagtgacaatagattattataatcttatttaattacatctacatctcagcaggcttcatttgacagaagcaaacatacagagaccctggcacttggtatgcatctatggatttgccaaagtgttttttctctatcccagcacacaaagagaaccagaagcaagtgtttgcttgcttgttttacctggcaaggacaatagtacacttttattatcttatcccattaagttacttctctggttttgtgtcacagttgggtctgaagcaacctcaattgtccaaaggacatcaagttgacagaatctaggaagctgaagcagcagatacccaggatgattggattagacaatttatatcaaacggtgagacataagtctcaaaaaaactacactggatttagggcagtggattttaggaagaggtgggggaaagggtctaataatggaggacatatagggctctatctccaaaatgaagagtaagttgttataccttgaaagccctatcactaggaatcaggtgccatgtttgtggacttaagatttgtacaatacattgccatctgactccatgggtgactcaactctcagtttggacaatgagatggtccagagctggtccaggatatagtaccagctactctgccatttagcacttgtgatccagctgatccaatgaggcctgacatgtctctggccaattgggatgcaatagagtctaggatgagacggatggcatcaccgactgaatggacatgagtttgagcaaactccaagagacaatgaaggacaaggaagcctggcgtgctgccgttcatgggcttgcaaacagtcggacacaacttcgggaccgaacaacaacaagtttgtggcaggccctgatagaagaaccaaagcagacaaccatatggatctaagaaaagctaagaaccctgagcaaatagcaaacctttagagagccggctctagggttaatatgctacaaggcaacatgatgtagtgagtgagcggaagctcgcctggctccaggctgccagagtttgaatctcatctctgtcactcactagctgtgagactgtggaccacagcttatcttccttttgtctcagttccccaccaataaagctggcttaacagtagggacttgttgagaggattaagtatgctcatgcatgagaagtgcctggcatggtatccagccacatgtgagtgctctataagtattagttatcacatccagtatgttgaacaagcatggaccgtgccacaaacaaaaccttagttgtgggtttcccctcaatccttcaagctcttctcagtggaatttatcttctcatcaaaagagcctagatgaaattctaggaagtcccatagctttcctactcatttctaggtaatacatgagtcatgttaagtcacagttttattagttagaatgtcagaaaactcaacttgacagtgttaagcctttaccctcccttgacttcttggctggaagcttctgctcccctcttcccctgctcacgtcctccccagatcgccagtcgttgctgtggtgccactggggcaaagcaggggtgggcgaggaggaaacaggggtctagaccagctctcattcagctggtgccttcacactgagtctctgggctgacagatggttggttctggctctctctcatgggttcatttgtggactctttaaaggttttcttctggacccttttctccccttcttcctttgaccacaaaggatgtacctattctgtgtggtctcttatatgatcttctttaatctctgggcaagcaacacctggtcagctctgcctaggtctccaggtggcctatccagtaagaccccaaatgaaccttatcaccactttctgcctcccattcagtcctgactggtcctcaggaaacactcagagtcatttcccctacccatcctggatccaggcatcacaggattgtttctgccaccagaaaaaggctcaccctctagatttcctaggagtcagatcccagcccatgggttaccttcgttgcctgagacatggtttatacctgtctccaacgtccacagatcttttcaatactcttccactgacccctgaagtcttcctcatgaggcatgagattagaagagaggtcagcaaacttttcctgaagagagctgagtagtatattttagactttgtagcctccagctctgtgtcataactactcaattctgcattgtagcttgaaacacagcatagagacaatacataacccaatcagcatgactgcgtcccagtgaaactttatttatgaaaaggtgatgctgaagctccaatactttggccacctgatgcaaagagccgactcattggaaaagaccctgacgctgggaaagactgagggcaggaggagaagggggaaacaggggatgagatggttagacagcgtcactgacttgatggacaaactccagaagatagtgaaggacagggaagcctggcatgctgcagtccataggattgcaaagagtcgaatatgacttagcaaccaaacaacaacaacgacaaccaggtttggcctgcaggcaaaagcttgccaatccctaggttagaggtagcattcctccattcttcatttcacttcccaaacagatggggtggaagcccgagaaagacagtcactgaaaaaaatatattaatttctttatctatttatttatttggccatgccaggtcttagttgtggcagactagacctggttaaacttgggcaccctgcactgggagcagaatgttagccactggaccaccagggaagtcccaacagccgctttcttatttccagtccttacaacaaaccctctctcttggtaccctgaccacttttatcacctcaaagtgggggagggtgtttaagagtttaacaaacactttctcagacatttctcttgaaaatgttcatacatggacttgcttcacaatcactttggtaattgatatcaaactggcaccttaattgaaaatgaggcaggaaatgtttcagatgcaccgagctggaagtggctgcagactccagctggtgcatccagtagacagccgaaggttgcgccttgaaagtcacaatgagctgggcagagttcctttctcaagaaaggcatagctattctaatatacgctgtcttgctttctaaaagaatgtggcacacaccctcaatttccttgttagctggggtctgacatcacagcaacctttttgtgacttactgtgaaaaggatgccagcaggggttgggggtggtggttatggaagtgcctagaaccagtttcttttaaaatgaatggccctgacagttttgtcttgatgagttcttgtgtctgctttctacagatttttctgtctccttcctcactataagtcctaacggcagccgcttggtgttgctgtgtttaccgttctccagcagcctccttccctatttcagtgcttttaatgtgcttggacttaaaagactcaaggtattataattgttggataaccgtaagagtgagggctgagtgactgtccagtcggtagcaggtatgatctttatatgtggacaataagacatctattttggttgtttgaagacttgtgtttgtttagctggaatatctattggggctgcttccagacattattcattcacttgcccttcatttacttatcttttggttgaatgcaggtgctcagccatattgctgatattttgccattccacccctcaaatgacctttgttttggatggggttggagccgcttttttaatcttccaattgatttatgtacatctgtgagtactctttatctatgaatgtttttctgggctcttcaggagtgagctgctttctagtttccacccctacagactgtagccagcattcaagagaatgtgttgagtactcacagacgtacataatttcatgtaaatacatataaatacaaatattcatttatataaatactctacgtatttttagaacatttgtgtgtgtgtgtgcgctttcttcctctcctgcttcatccatattagggcccctttcccaactgtgatggatcatgtgccaacaactgtacatatacccttccatatatcctgcatacagcacacattcacacaccaagtgtctttagatggcagtcaatctttgttgttaattcaacagccataccttagggctcttcctcacccttcttttttttaagtttttttttaaaaatgtggaccatttttaaggtccgcaatcaatctgttacaatattgcttgtgtttcatgttttgtttttttggctgcaaggcatgtgggatcttagctcccagccagggactgaacccacattccctgcattggaaggtgatatcttaaaccactggaccaccagggaagtctctgcaccttcttcttcttttctaataattattatcattttttttaaaagttttggttgtgctgggtcttcatcgctgtgcatgagctcttcctttttccactttcctttcctcagagctcattcccctattttggtgccaaccacataaagagctcagagacagaggctgacacaaaaacgaaccaggtgggtcccttggggacaaaggaggatgtccacgtggaattttctagttggtagctggaaatacagttgccaaccaggggagatttcagacctgtaagtggggagggacagcaatcactgagatgtcaggtgaaatctcaggaaggggaggacgctggccagagaaggaaagcagaccaagaagaaagaagagtcttgtacagtatcattagtttatacttgctctggaaagcatacagtctaaagcattagaaacaatgctgtttcctcttgaactctttatctatgaatgtttttctgagctcttcaggagtgagctgctttctggtttccacccctacagactgtagccagcattcaacagaatgtgttgacatgtgaagggcacagaattaacaggaatattgctttctgaatgtcatcttttctttcctctgaattgatttcatctactctttttaaaaacaagtttgtttggaatggcttttaagaactatttccacacccacattatgaacacatgaatctaagtcaatgttctttgagcaaaggaaagtctgcaggtggataaaatgtcttgctgacttctgccacatgtatttacaattcaccagccatctttctaacaggctgcattcctactgcttcaaggtctgctcacaaaggatagtcctcatgaatttttgttatttgcccaaaatttcctattggaggatttgatttgtgtgcctggagagtcagagatggaagtctggcagtagctctgcaaatggttgccaggcttccctggtggctgagatgataaagaatctgcctgccatgaaggagacccaggtgtgatccctgggttgggaagattccctggagaagggcatggcaacccactccagtattcttgcctggaggattccacggactgaggagcctggcaggctacagtccatgatgtcgcagagtcagacacgactgagcaactaacattttcacttcctattggagggtttgatttgtatgcctggagagacagagatggaaatccagcagtagttctgcaaatggttgtcagatatcccaaagcaaatagaggtgctgccatcttctgaaccgaaaatttgtagtaaatgctgccaaggcacccaaagcctagctgataacacatattccctaaacaacttgtctaaaagacctcccaaatactatcaacatataaaccacacaaccctattcaggatagcaccccctgcatctaattatctacttcaaacagaaggatgtgtgttcagtctcatccgattctttgcaaccccatggactgtaccctgccaggctcctttgcccatggaattccccaagcaagaatactggagtgtgttgccatttccttctctaaacatcttcctgaccccaggattgaatcacatctcttgctgtctgcgccatttaaaagccctcaaacttaaggatggtgctgggtgctcagatgtgtccgactcttttcaaccccatggactgtaccctgccaggctcctctgtctatgggattctccaggcaagaatactggagtgggtggccattccctccaccagggatcggacttgtatctcttgcgtctcctgcattggcaggtgcattctttaccactgcgccacctgggatagctagtgggaagttgctgtaaaacctaaggatatcagatgtcaaatcttgttccttatacattcaaatctcaatagaacggtacacagaaaatgttttcctctgggccatcattccctcagttctcatgcagacttccctggtggtccagtggctaagactccaggcatttctggtcagggaactagatcccatatgccgcatcttaagacccagcagtcaaataaagaaatattttttaaaaatagctgctgctgctaagtcacttcagtcgtgtccaactcttcgagatcccatggactgcagcctactaggctcctccgtccatgggattttccaggcaagagtactggagtggggtgccattgctgagtcccaaatgccaaatatctgaagctgaagtcaccaccttccccccagctcaagacttcaaacttccttggccaaatctacttccctgaattacaggaggaaagaagactgcagttatgaattgagggagaaggaactccattagactttatagatcccttttaaaattctgctgctgttcacagaaagaggtagaagaaggccaagggcacaacagaccttctcccgcccccttttcagataatagcaatataaggtaagaggtgctggggtcatggaagcatatggtgggagatgttgagtctggctgggaggagaagagagaagctgttcagcacagtgcctgacacaaagtaggtatctgagaagtgattaataattgaaaggaagtatcgtctgaatgggcttccctggtggctcacacagtaaagaatccacctgcctgggattcacctgcaggagacctgggtttgatccctgggttgggaagattcccctgaagggaatggcaacccacaccagtattcttgcctggagcctggagaattccgtggacagaggagcctagcaggctacagttcatggggttacgaagagtcagacatgactgagtgagtaacacacacatacacaatgtctgaacatcaaccaggtgctaaatcggtctgcctacatgagacgcagggaggggttttacataagcgcaaaggtgtgtccagggaatgaccaaacttgggttgggcccctggccgtaggctggaaacatggtgtgggagtcttggatagtctttggcagactatggaatatccagaaaagccaagaggaagatcttctaagaactgtattttctaacgcaatggccctgtgggtaactacttctacagaagccaaatgggttttaaaaaacataatggtagttcaactgagagagaaaaaagggagtgtaatgaagtagaggccagatgggccctgaaagaatattctgcttgttccttcaacaaaattaagagtgcacttctcacaacctaaaagaaaggagcacagtcttccttcattctacagctcttccctggggcccttacaaacttgctttcatagtcaagactgtcgaatacctcctgctgccttccgctgagtgcacgccagtttggcttctgttctacactctcacccacattcctgcagaggtccccgatgctctcaggtactttccaacctgtaccttgctgacctccaactccagcatcagaaggggctgacctctcctgcagcattcttcctcggccttttctaactccagcttttctcctctcacacagctcagttcccagcctcctttccccttgtctgtttcagtgagttgtcagtttcagctcctcccatcactatgtgcactaatgactcccagatctccacctcctctcagcatctctccccactccactgtttacctaactgcctcttagacatcttcacttatttgccccaagtggcagctcaaactccacaggccctgtaaggaaatcatctggccttgggcctggtagttaactgggcctcactgcctcaactctaaaacaggggaattacctatagtcacatcatacagaagcccattatgcagattaaatgaaataacacagactagcatgtcagatagggattcccaggttgtgctagaggaaaagaacccacctgccaatgcaggagacataagtgacacgggttcaatccttgggtcaggaagatcccttggaataggaaatggcaacacactccagtattcttgcctggagaatcccatggaccagaggaccctggtgggctacagtccatagcgtcacaaaaagttggacacaactgaagtgacttagctcacatactcctcctaattatatcacacaatacctgggatgggaagatcccctggaggagggcatggaaacccactccagtattcctgcctggagaatcccatggacagaggagcctggagggctatggttcaaagggtcataaagagtgggacaggactgaatcgacttagcattcaggcatacatacgtgaaagataaacataaagactagaatccaccttccaatgcaggggacacaggttcgatccctggttgggaactacggtcccacatgctgcagcacaactaagcctgcatgctggaatgaagaccctgaatgccaataaataaatttatatatatacatatatataataaattaaaaaataaacccatgcacttcattgagccagaacctacagcatcctccttgatgtctccctctaccttaacatcaattgttctgtcccagcccatccattcccccttcataaggtatctgaccttgtctctctactccattgccttaaaccctcagcatcccatggggctagggctattctttccctgaccccactctcctactatacacagtagtcttgaaagagcgcactggacaccatcctccttttaaaaacctttcaatgccgcccttggggacaaaacccagactccttggaagggcacagactgctcagggcctggtcacagtccttggcactctctaaactccagctggttctccttgagttaacgccaccgtgctcagcaagctcagtcaggccagagtgccttcttcaaccactctggccgcttcttccagatacaggaagatgccacttcctctaagaagccttcctggacttccagtcagacgagtatctttattccccagggtccctaccctaacacttaccatgccatcgttattacctgttcatttgcctgtcctctcccactaaaacgagctgtctgcggaaagagaaattatcctttaatttccatattcccagaacccagcacagcgcccggctgacagtaaggttgcgagggaagtgaatcagaacagtgtggccaccgaaaaaggaaacaacgcggttgtaagcgaatccactcctcccgcggccggcaatacagggctccctttaggcctgcgtggacgtccagggcctgcaagtccttctcggggcttcagcttgagcagatgtaacccgcaccatcagggcagacggggtacagcatcggcagaggctgcgcgaggagcccgcaaatgcatgcctagcgggctgaggtaaaaaaaaaaaaaaaatcctgagccctttgttccaggcggcggagggtaagcggctccgagtcctccgacgggtgcagggcctgcctgggcaggatggcacacaaaaacgcaccgggcagcgccgcgtccggtaggggcgcgcttgtccgcgggccttctccgtgcccccttcccggccctgagatttccccgaactctccagcgcccctcgcggggacccggtgtaagtgcctggcggtctccccggcctgaggcggcagcaggcgggaaagggctcggcgttcaggcgtcacgcgccagcggctggccggacggcgcgcgcacgcgcgcgcggggcggggcgggcgcgggggcgtggccggcgtgggcggggcggggcggggcgggagccaggcacaggaagagctgggaggccggagccgtcccagtgtgccccgcgcggcgtggactcgggtcgctgccgccatcccgctggcgagaggcagaggagaggcccgcccgcttgccggtcgggccagtgtgggccagtgcgtgagggcgctgggggccgtgtcagcgagacgcagagcgcagccgccgccaccgaacggacatgttggagcccagcgccgccgccgccgcctctttttcctcatcctccgaacgggactgagagggggcccgccacccctctgcctcctcagcctcagccgcctgccccgccgcctcggccgagcctcttcctgcccggcctccggctacgccgctcgttgcctccgccggcccttcaaggcccggccggttcctcagctcctctccgccgcggcgcgaggtcttatgtgaccgacgggcccggagcagccgccgtcgccgccgcagcgcgaacatggacgccgtcaacgccttcaaccaagaggtgaggggtgatcgggacatgggggtgccgggggcctaccagggggagctgggccgtcgtttctcccgccgcctgaggtttaaagcttaggtcggggtggggacgcttcctgccccggttccggggcggcgggcctgcgcggagcgggcctgtgtggcccggggaggtcgcggcggcccggtcgccgacccccacacccctcccccaccgcccacccccgggcggcgacctcaggctgccccctctcgcccccttccggcctcgtccagcccagcgacggcctccggtgtctttaacttagccccccacccttttcaggtctgggcgctctcgccctctgctcccgttattggcttcgcggtgccgggagcccgcaaggggctaagaaagaaacgcgggcgggcctgggtcgggggggtgggtggggaagccgggagcatctgccggtcgcggggccggcagagcggtggcctgggcttctcctgttgctcaggccgcgcggcgcgccggctgctggactctgatctcgggtcggggaggagttggtgagggtattcatcccccctcccttcgggattcctgcacttgggaaatggagttaatagacggggctctttaccctcccgagtcgtgaactcaaccctgttacgggctccgtggccccaacgtgacacctaaaaagttgaatgggagaggacagcatctgctccgccttagaccgctagaaagccggctttggcctccagtcctcccaccctcgcaccctcctcgcggttggttaatccttggctcccttctttgggaacatttacatgtgaaaaacctcccaaaaccggtaacaaagctgcctgccgccctaaagctctctggttttatctcaaaaccttccaggtgctgtttttgaagtgtcgagtccacagattctatttttcagaatccatttcagggagaggggtcttgaccattgatagcaaacgtacctacaaaatggaaacaattggcatatgttgagttggattatcttccttttccaaataccgccgatcaacccaacactgaaaaaaacagatgtagcagtgctagatgccttgggaccacgttgatgacttggtgcaccctgcacaacgtgattttgtagtttcacttgtaacaattagggtgcagtaactttcactttgtagcgcctccagtaacactgcagttaggaccgttcattgccttgtcagttatcctagacgtgatttgtctttaactgatgaatacagaaagttggacagtgtcttttaaagttctatattgcctattttcaaaatgatgaaatagtatttcctgattttttttgatggctagggcgtttgtgataatgccccaaagatttcaggattgggagttgactttgtttcctgaaggcaaaatatactggaatgttggcttcatgagggtggagagtttctgtcctttgcttcctcatagcacatgcttggaaaaaacttgttgaatgaatgagaacttacacaaatgacacagtgttttaaaagataggtacataacttatataaatgacacagtgttttaaaagataggtacatttctttctcaagatgaaaactttctggatgttttcagtgaacaaagaggaagggttttagcctattcttaagaccagaattatttaattatgattgaggcattatggacattaagcacgttattaagtatcacgttaattctgggaaaatgtgatcagtagtttttactttgaaaaccaagattaggaatgatagtgtcttcttgaaaaaggaaaacggcattttgaccttttaaaatgtacaaagtaagagttttcctatcatcgatcattttcctctttaaataatttttatttccgttcctagtctttattaactgcattatgttaggtgtatgttaccaattccagctcttttctgccaaactttcttccccaaaaactttcttccggagaaattagtctgactttgaaatccatctccttgtccctgcttgacgtagtgcttctcagttaattctccccattcataaaatgttagtggttagttgcatgtaaccttaaatctccgaaatgttcattttacaaatatttgagagcctgcctagctgtaaagctgtgtcctaattaggatggcactgccactaaggatctctgccccctaggagcctaaactaatagaggacacaaaacttagacaagtaactttaatgtgtgctggaacaatttcctttggggtctttttaaagtactgtggggtggccatggggcattagacctgggagaagagagtgtcagtctcagaatttccaaaggtgtaggaaaagtaattcaaaggcaacattggtgagaaataaggaacagtagtttgactcctgaggctactgaaagggtggttaaggtagtttggggcctgacaagtttcaagtctgtctaatatgtttgaattcctttttctttttttcccagtctatggataaattgaaggttttaggcaggggagtaatatagtcaaaatactgcttgatttatagtatgtattgtagaaggcaaaggtttggggaaacatggcgggttggggactgaggtgggagaagaaagtagaatctgagcttggcatatctataaagggactagagaggaggggaaggatgtggacctgaagaatctgtggatttgacatctgatagatttataggcaccttttgccctggacatctaagctctgggagaggggtgacacatcaagcagtcatcaaaagtatatttagtggagggggaaatatgtttgattttgaacagtttatgtttgagtgaaacagtcatgtggaaatttttggctagcagttgatcatattggactcaaacttggaagcaacaaagagttggaggaagacatcaaagagtcactctcagattgccttagagaaaattgagagggggagacaaaatgaattaataataagcatctatagcatgtgaggtgctttgtatatacatatcgaagttaatactccttcaaccttgcgtacacgaaagctgattttcaatttcaaagaaatcaaatagtaattcacccaggggcatactactagttcatggcagagctgaagtttaaatacagatggtcccatcttaattactgcctgaaaataatattttacataataccaagggaatggtcataggttaagttatacaaaggccacaaaattttttgagcacatgggatctgtagtttaagattgaatggtgatgggagagatatggataagaggtagcaaatataaagtagttgggtgttttgggatttattgttgttttagaagtttggttgtaaggtgttctgcggaaaagtctcttcaaggatgaagggaagaaagagcaattgacaatgtagtagacgctggtgctagccctttgatatgtttatatatatagtgtatatgtaaggtcttaacctaagtaagtggtgttcaagccctggtctttatcagatgggtgtagatgctagagcatgttgagggaggggatgtgcaaaaaagcgtagttcaagtggctagagggattggttaacttagaacaaaattgtggatgaaaggaaggggacagatcagaagcacaggtaaaagtatgtatctgtgatacagaaaaagaggaagataaagatatggttaaagaccttttgagagaactttcatggcaagacactgtgaagtgttgtaaagaatggaaagatgagtttaaaaatcagtgatctcttaattgtgttctatatatactccttgttggttacatggataaagattatagattggaattttttaatccattgattgcgtttttagcctttaatcagtcttctctaaatcaaaaagaataactcttccctcatcctcgcttttctttttgcagcatctgtgattttaagatctttaattaaagtacaaaaaaagtgcagaggatataacaaaaattgacagttgttattaggtgtttttaatttaaaaataaaatattatgatgtcttcgtttcctccctttcccacccctctacccccccaccaaccccccaatcagaagcaatcaggtaatgaatttagtatcaatctctgtggtccctaaactgtgtgtgtgtatgtgtgtgtgtgtataaaatctgttttgataacatattccccagtgttttgtgtgtaaaaattactaatgctgtatgttaagaactgtatagttcattctgaccattgtgtagtattctatcatttgaataaaccgaattttatctggttccccagttgatgaacgtttgtttctcatttgttactgatagacactgcaatcaatgaactttctcagacatgtctctgtgtaagagtttctctcgggcagctgttctcaaactttggattttgactccttcaagctctagaagttaaggaccacagagactttttgtatctatggattatatcttgatatttgctgtatgagaaattcaaaccaagaacaagatttattaaaaataataaacctgttacatattatcataaataacatttctaatgaaaaataatatttccaagaccaaaaaaacctagtgagaaaatgacatggttttatctgtttgcagatctcatttaaacttaggtttaataaaacttgaattcttgtatatacttcattcagtttccagctgttacacaagtcaggtagcctttggaaaactccactgtatacttgtgagcttaaggataaggaatgtcttagcattaatatgaaaacagtttttacctcacagaccactgaaagaaagtcagacacccctgcccacccccctccatcctagagtgtctttttaagaagtacaacatagagatggtatgcatgtaatgatactttaaagtgcaggaagaaaacaggagtacttttacatttgtgtttatcttttttttttttggctgctcctgatgttagtgacaaatgggatcttttagtttcagcatgtgaattcttagttgcattatgtgagatctggttccctgacaagggattcaaactgggccccctgcagtgagagcacggactcttagccactggaccactaaggaagtctcttttgtttatctttaaaatcagacaaattaaactttatgagtacttttaacatatgagttgacattactgcccttaaccacttagttgtcagtcttgaaccatgttactctgaagaagaattgagttccacatctcattcgggagcttcctagtcccagtggaaattgttctatataaactgttctgtattttacctcttaaaattactagtatgattgtcttctagactttagatcatatgatgacagtaccttgttaacttttttttttaacctgtaatgttaatctggttgtttttgattattcccttgttctctgagaggtctgtctaaagaagcggaccaggatttgaaacaagttcttaactgtatggaagagacgtatcggaccggggcaacagaagtaaattttgaggtttctcatgactcatctgactgttacactatttataacaggggttggaatattaaaagttagttgtaattttgttcctcttgacttgcagagatttacttatctctgacaatagtagaagtctggctttatgatgagtggaataaagctggctcttcagagctttctgtagcagaatttatcactgatgttcttgttgaaaacagcccactccctagtctatcattttgtttagaattttgtttcagaagaaaaaaatacgtggacatatgataaggaactgattcagagaataatgggaataatggaaaagttggcttgtaaatcttgtggaacagattcgcagggtggggggagtacctgataaaaagttgacaagatggccgttggtttttggggagagttttgtttttgtttttaatgtgctcagtcacgtccaactcttttcaaccccaaggactgtagcgcgccaggctcctctgtccatggggattctccaggcaagaatactggagtgtgttgccataccctcctccaggggattttcccaacccatggatcgaacccacatctcctgcattatgtacagattctttactatctgagccaccaggaaagcccaagaatactggagtggttagcctatcccttctccagtggaacttcttgacctaggaatcgaactggggtctcctgcattgcaggtgtatagttgattaacaatattgtgttagtttcaggtgtgcagcatagtgattccaggcttttctttttttttcaaattctattccattattattatgttattacagagataccttgttatcttgtagtatcaattgtcccttcccctctccagctccttttctgttaaccataagtctgtttgctatgtgagtctgtttctgttttgtatataaattcctttgtattattttttggattacatatatgtgatatcaatacttttctattatttcactaagcactctccagattcatccacattgctgtcaatgacaatatttcagtttttatgtccgtgtaatgttccgttacggaaagagtcagacacaactgggtgactgaacaacaacaacaaaggtccactgtgtatatttaccacgtgttcttaagccagtcatctgttggtgggcacttagtgctgctgtggaacactggggtgcatgtatcttttcaaattagaggggtgttttttttccctagatatatacccaggaatagaattgctaaatcatgtggtagttctattttaatattttaaggaacctccatactgttttccatagtggctgcaccaatttacattcccaccaacagtatataagagggttcccttttctcaaaccctttttcagtacttattatttgtagactctgatgatggccattttgaatgatgtgaggtgatacttcattgtaatagtttttatttgcatatctctgatcattagcgatgttaagcatctttccatatgccagttagccatctgtttatcttcttcggaaaaacatctatttaagtcttttgcccattttttgattggggattttttttttttttttttggttgtatgacaggtaatttttctgtagataatctgcatgtgtttaaaactcatttcaaatatactttgataacacagggaaaacattgttacataaatggtcaacctttagaagtttgtgataacgtttgttaagataatatacagaatcatttcagagcgacaccatacaactttttaacaataagctaaaaacaagctgtactatgttattaggtagtgtataggaaaagcagctattaacaatgtaagttttgatagagttggtaatagttaaatttggttaggttttaccaagttccgttgtgagcttagtctagaagagacatgttaacatttctgtgttaatattaagtgtaattaacaatgtactgttcatgattttttttttttttttttttttgcgaactggaagattaattgctgaaacggtattataatttattatgcttcagtcaccttcatccttttcaatatttgcatggcttatcaattaacattttattgtgttaggactctattggtgcttgtgaagccataggtatttatagaaactttgataatattgagaaagcattgtataggttagtagtgaattcagcaagaaatccagtgacactctgaaggggatttaagaattagaagccaaggttcagatgggatgggggaaataacagggctcttgaaaagtggagggccatacaggtaccccttaaaggttataattggtgtttggataattcatgatttttggtataaatccaagtgggtcatgtggaggagattgtagacagtagcatacctaacatatttgacatcctgagaacttttttttttagcttaattcctcttttacaacaaaattattttcaaatataatcatgaaattagccaggaaagaaatttgaacttcatgtcacttacaagtaaatattacaacaaagaaataattgattaatgttttaaattttcattaatacttctttctgttatatgtagaaaatcttacctacgtactgctctataacagtaatgaataataatattcaggctcttttaagtcttaacttctgcatatttattaaatgattgtcagtgttgatcttcacagtatttgagttcagtagacaattgtatggagaaggcaatggcaccccactccagtactcttgcctggaaaatcccatggacagaggagcctggtaggctgtagtccattgggtcgctaagagtcggacacgactgagcgacttcactttcacttttcactttcatgcattggagaaggaaatggcaacccactccagtgttcttgcctggagaatcccagggacggcggagcctgatgggctgccgtctatggggtcacacagagtcggacacgactgaagcgactcagcaacagcagcagcagcagcaaattgtagtcagatttagcagtgttatctccacctctaagtggttgaagaacacttctcattaattctgtttactaaaggttgtatgtgtagcggcagatacacaatagttgggaaatcttaaacataaagttacctttggcacaaatttaagaaaagctcacttcacaataaattctggaaatcaaaatgctacccatgtcttttttgacatcaattctagtgactttgcctggcgactcagtggtaatgaatccatctgccaatgcatcctgcatcctggcatcctgacatgtgttcgatccctgggtcaggatgatcgcctgaagaaggaaatggtaatccattccagtatcttgcctgggaaatcccacggacagagaagcctagcaggctttagtccatggggtcacaaagagttggatatgacttctctgctaaacaactagtgacttccaaatgtactgtcagtcaaaaaaatttcactaaaatattttcacccacagtttctatagaggtctctattgtaaatgatgaacctctttaagattatgtgtaatggcattctccataatttttattcatggatcattaagctttgtgttttctttaagactcactctgctgtttataaatatttataccacaaaaaaaaaaaaaaaagatatatcaggaatgaagaactgcagctatcatactttaaatgtactgtttaaatatttgaatatatacacttaggaactgcagaattggagatgtaaaatgagcctgaggagagtacaggctatcctgaaaaacaatctcggtcaaccaaatattttagggaaaggaatattttatcccttatatcatttagaattgctagtatttgctgatgataaaacagttttcaaacagttttattattttgtaagtctttaaagacaattcacccactttttgcctgcccctgggtggacttctcccattgttccactctaggtgtgttattactctggagagcagtaagtatctaatgctatagtctgtaaatctgcagtatcccctgtatatctttatgccttttatcgtgaatactccactttaatccttcttttgtcagagtttagtcttagctgatgtagaattagaataccctatagaaagcctgtaataaggaaatttatggtaatacccttttaagttttcagaaaacataaactattctttaaataaacagtcacatatgacctggtccactgtaattacaagttgctgaatgatataaatcactttatcaaggacagccgagtttggggttcagttggagatatgttcaaatctttatgaagaccttaaacattgttgactaatataagagcatattttataaagtttggagttttgttttaatatagtagtccaaaatgggcaaatctatatagagagaaagtaggttattcatgaggggatggaggaagaatggggatgactactaatgggtatgggatttctttgaagtataatgaaaataattctaaaattacatagtgttgatggttgtaactctgaatatagcaaaagccactgagatgtacactttaaagaggtgagttttatggtatatggattatatctcagagctcttttaaaaataacacagaaaagttatgttttaacaccattttcattattttattgcttgatttgattgacagattgaaaacaatatctattagctgctgagtggctctgcaggttgttttgttgatcctgaatcataagtttgttgaaaggatatctttagtttttacatgctattttaagaagtaatccagcagagacagttcaagggaagggtagtaaatgaatcttgcatttgcttattcccaactagatactagcatatgggttaggtgtcttatatatacctttctttatattttatatatacctttctttctattttatatattctatatatttcttatatatacctttctttctattttagaggtaaggaagctggaaaggatggtgttatttgaccgagaactcttaagaggctgcttgagtccagtccacagccccacaatactgctctgaagttttttgagcagctcatctctgtctgttgtattgttaatgaagggagagggcttcctgaacaactgttgtatatttgactcaaagtagcaagggcactgtaatgtatatttgtgggaggatttgccagagtttaagaatgatgaagtttgggagtttttaagtcatctacagtaatgcagtagatgcagtcagtgttttaaactgaagatttgctttttagatgttatatttcatttgctaatttatagtcacaattaaaaattttaattaattggggattttataaatgttaaccttttcagttttgatcccatgcttgtgtgtagatctagtcattacaacttggtagggagaaaagtagatatggataaaacatacaatgtataggatagtctggaaggaactgtttaattcattaaaatgtttgatagccagctttgggtaaacacaaagtttacttagtgaggcacaataaaagcaattttgaaacctggcagctatgctagtaaaatggggagtaatggtatgggtagaatatttggcagttgcaaagatcaaatcctggcctatttcgtgagcaagtgaagacaaaggagttaaggattgattgcagttcagtgaatcaaaatggaggtaaggaataaagaatgacctagtaagtggaactgagggggttaaaaggcctgacagcgggggtgcagcagccttggttctaaagtaaaaagtttaattgaaaggtagacccttgtaaattgtaagggagttagtcttacatgaagaataaattagggcatactttgtggagtgagtcatcagaaattaactgcttagaaaattagttctggcagcggcaaatggtaacagaattagggattggtgatgtaattaaatagggaggaagtttaaactactgtttgctatattactatattctattttcataatgcacatagaaacataaatagttaacttgaaagtggtttcatacataatttagcagtatatgtttgcgtttatttgtgtgtattttgtaaagcattttccttggttctggaaccaggagaaaatttggtgagcttgtgggtaagtgtagtaaggtaaagaagtgtagaaaggagtaagtatgaaaaattttaagactctttaaacttgagaatagtatatgcatctttgctgtttgtaaaaatacctggtttataaccttatggggaaataagtagaactgatttgtagtgtttaagtaaagaccctgctccataggagcagaggaactgtgtagtttcttttttcccatctaaagagccatgtaaatttgccctgttattagacatactgtatattagtgccagacctgtcttgtctccatacattcctttaaccaggtggaaaattgattaaatatttgggtttcaaaggatttgactctctggaaagtaaatataacttacatgggagtaaatccctgggttgggaagatcctgtggagaaggaaatggcaacccactccagtgttcttgccttggaaatcccatgggcagaagagcctggagggctacagtacatggggtcataagagtcagacacaagttagtgactaaaacaaaacaacaaaaatcatatatcagtagttaaagggatgctttctttaatgcacagaggtcaaaaaatatacttaagtgatttttcagttttgggttttatgcacaaagacttcagatacaaagattttaaatggcagattttatgtttattttaaaaattttgttttagcagtttgaaaagttaaagatttataaggcattaatttaaacatatgtgttaacttcaaagatatggtttactccacagacaattcgtacttggtaatgatggtcctatacatttacaatcaagttggagaaatgcatttctgtgtctcagacacaaatgtaaagttttccatttttaacccatgatttaatttatttatttttgaactaatgcaaattaggtaaatttaagtaagaagatatcccaccaaatatctttaacattttagagtatgtcagtctttttttccccttccacttgtgtttggatatggttaccatatctttttgataacatgaattactttctgattttaaaagccatcttgggaatttggggaacatctgatttagataaatttctaaaaatggaattgttggtttaaaagatatggactttttgagttcttgatatatatagctttagatttctctctgaaattgaaacttggccgttagttctcatcagcagagtgctttctttgctttttgctaatctacactcatgccctattagatacctaagtgaactgttatctcattgtcttaatttgtacttttttgactattggtaagactgaacatttttttccatgtttattaattagtttctggctctatttgttatactttgtacagtttccagttttattgtttttcttagtgtttgttattaactcatgcatagtattctgctttagggtagagtggtataatggtacttgtctaacatgcttggcttgcagctcttctttccttccctgcgctgcaccccacccccccacccccgccccccgctctctctctcagtctctttgtctcacatatattcacacggtcacattaagtgcccagtattaaagaattagctcagacaaagttttggtaaaggcataaaatgaaatgccagttaagaagagactaaactatctcttacctgattgttctagcactattttatagagctgtcttcaggctataattagagggacaaagcatctttgtggagatgattttaagattttccccctacgttttcttttgttaaatttaatgtgtgcttttataaagtatattttatcagtaaacatttaagttaagttggctttaactcttgatttggttgaagccaatgtatcagatttgatgagacagatgaacaaaagagggagggagattgtagacttgaacactttgataacttgatctgtcagaagggagatttgagtaccagcctgttactgtgagtatgtgtatgtatttttggaagcatccaaatttttttttttaactttgtaattaattattaataataggagcttaaggcagaatttgtcatcacggagatcataatagcaaaggaaaggaatactagatatcttaaagtataattcattatagtaagtttcagaggataagatgggataagtacaccattgaaagagattctgcctagagatttctagtcacttggagctagaacagattctcacagaccaattaaacatttttctttcataagaaagaaaatgtgtttcatctagtgaggactgcatatatttcagatatttgtcatgatttcatcttgaataaattagaaaaaatattgataagttgagagtattgttaagtgaattttatctaactggcagggtccacagaatattagataaagtcttcctacaagttgcaagtatcagttcagttcagtctctcagtcgcgtccgactctttgcgaccccatgaattgcagcacgccaggcctccctgtccatcaccaactcccggagttcactcagactcacgtccatcaagtcggtgataccttccagccatctcatcctctgtcgtccccttgtcctcctgcccccaattcctcccagcatcagtcttttccaatgagtcaactcttcacatgaggtggccaaagtactggagtttcagctttagcatcagtccttccaaagaaatcccagggctgatctcctttagaatggactggttggatctccttgcagtccaagggacactcaagagtcttctccaacaccacagttcaaaagcatcaattcttcagcgctcagccttcttcacagtccaactctcgcatccatacatgaccactggaaaaaccatagccttgactagacaaacctttgttggcaaagtactgtctctgcttttgaatatgctgtctaggttggtcataactttccttccaaggagtaagcgtcttttaatttcatggctgcagtcaccatctgcagtgattttggagcccagaaaaataaagtctgacactgtttccactgtttccctatctgtttgccatgaagtgatgggaccagatgccatgatcttcgttttctgtatgttgagctttaagccaacttttccactctcctctttcactttcatcaagaggctttttagttcctcttcactttctgccctaagggtggtgtcatctgcatatctgaggttattgataattctcccggcaatcttgattccagcttttgcttcttccagtccagtgtttctcatgatgtactctgcagataagttaaataagcagggtgacaatatacagccttgacgtgctccttttcctatttggagccagtctgttgttccatgtccagttctaactgttgcttcctgacctgcatacaggtttctcaaaatgcaggtcaggtggtagtttcaagtataggtctttctaatttttaaaaaaccgtggtgttgaaaaaagccatctgtatagcagattcatgaaagttacaaactaattggaatagctgctacgttgaaaacagaaagtgatttctagactacctaagtagattgaaggactgtcagaaaccaacataaaatcaacatgaagttctagttctgatgaagattgcagtgaaacagtctgagggttttaattggttataaatatgagttaataatgaattgagcactatatttaaactgcactggatcttcattgcttcattggctttccctagttgtgatgagggagggctactgtttattgcggaacgtgggcctctcattgcaatggcttctcttgttgtggagcacaggcttttgggatctttcaagaccagggattgagcccatgacccctccattggtagggagactcctatccactggaccaccaggaaagccccaactatttaactaatatgcagagtacatcatgagaaacgctgggctggaagaaacacaagctggaatcaagattgccaggagaaatatcaataacctcagatatgcagatgacaccacccttagggcagaaagtgaagaggaactaaaaagcctcttgatgaaagtgaaagaggagagtggaaaagtcggcttaaagctcaacattcagaaaacgaagatcatggcatctggtcccatcacttcatggcaaatagatcgggaaacagtggaaacagtgtcagactttatttttgggggctccaaaatcactgcagatggtgactgcagccatgaaattaaaagacgcttactccttggaagtaaagttatgaccaacctagacagcatattcaaaagcagagacagtactttgccaacaaaggtccgtctagtcaaggctatggtttttcctgtggtcatgtatggatgtgagagttggactgtgaagaaagctgagcgccgaagaattgatgcttttgaactgtggtgttggagaagactcttgagagtcccttggactgcaaggagatccaaccagtccattctaaaggagatcagccctgggatttctttggaaggactgatgctaaagctgaaactccagtactttggccacctcatgtgaagagttgactcattggaaaagactgatgttgggagggattgggggcaggaggaaaagggggcaacagaagatgagatggctggaaggtatcaccgactcgatggacgtgagtctgagtgaactctggaagttggtgatggacagggaggcctggcgtgctgcgattcatggggtcgcagagtcggacacgactgagcgactgaactgaactgaactgaactgaagcagtattttaaaatttaataataatagatgatctcccctaccctagagtgaccatgttctgaatcctagaacctgagaatgtgttaccttacttggcaaagagactttgcagatgtgaataagggtttgagttgagttaattgtcccatgttatctggatgaacccagtgtaaccccaagggtccttaaaatgagagacatgaaagtcagagaaagtgaggtacagtgaaagcagaggctaaggaaggacagacgatgctatgctgccagctttgaagatggaagagccaaaggaatttaggcaccctttggctagaaaaggaaagaaatagattttgacctagagtgcccagaaggaaggcggccctaccaatgccttgatttcagactaatgaggttgtgaattccacaagtgttgttttaagctactgagtttgtggtaatgtgttcctgcaagaagaggaaactgatacaaaagacaacccactagattccacaggaatatatccaggccctctttattttgttttatcatacttttaaaaggaattagccagtatagtcagatctagaaatcatatcatatggctaatagttgaagccgataagaaaacatgcttagttatgtttattttctcacatgagaaagatcactattgttctgtgctccagaggcagaactagagcaggaaaagggagggaaggttatcagaagggagatttggggtcagtacaaagatgacagctgtaaccgttgcagctgattagttatgagttagtaaccctgtgaactaatatgggacctgccagatatattgtgaaagcagttgtgaatttagtatgaatactagattaggtagtaggtgctatacagctgcagaagtctttgatactgctgtgttttcagtatagagaaaatttctccaaatgcagcacttgaatagtagatgtaacacaataaagtttttatgctaagccataataaaaaattgggcttccctggtggctcacatggtaaagaatccacctgcaaatgcaggagacctaggttcaatccctgggtcggaaagatcccctgaaaggaatggatacccactccggtattcttgcctgaagaattccatggacagagaagcctggcaggctacagttcatgggtcagtaagagttggacacaactgaagcactaacgccttcagtttcacgacaaaaacttaaacttgagatctgtgttaagattcccagggcattatgtacttctttttaccgagccacttatgtgtcagatctaggccaagagatttatatatacattatctcatttaatcctaacagttttatgaaagtgaagtcgctcagttgtgtccgactctttgcagtgccatggactgcagcccaccaggctcctccgcccatgggattctccaggcaagaatactggagtgggttgccatttcctgccatcttcccgaccctgggatcgagcccaggtctcccgcattgcaggcagatgctttaacctctgagccaccagggaagcccaacagttttatgaagtgaattgaatattactaatcctctttttcatacatcattgaaactcagaaaagttttaactaaacttgtcaaagtttatgcagtcaataaatagtagagtatcatgttattttgactaaccctcaaaccctgtgaattctataagtgtgatgggccaaatttaaaattgttctttattgataataggaatcattgtgagtgatttttttttcataatttttagaatactttgtatatcaggcacccagcagaacagtgttcatgtttagtttttctaatagttattcaactgatgacaacaaaaaaaaacaaacttgtgtctattgctagcaaatatgtttttcttactaaggctttctaaggaggttttgtaccttttggggcccactgctgctattatcctctataacagaattgcatcattttctgtgggtgcgttgacactttttgtttttggacagatcacattaattctgaatgcagatgtgtagtagcaatgagagcgctgcacctagtgatgtttattgagcatttgcccagttgcagatgatagtactagtcattcagtttagtcgctcagtcgtgtctgactctttgcaaccccatggactgcagcatgctaggcttccctgtctgtcaccaacacccggagcttgctcaaactcatgtccatgccattgaatggcatcggtgatggcatttaaccagctcatcctctgtcatccccttctccttctgccttcaatctttcccagcatcagggtcttttcagatgagtcagttcttcgcatgaggtggccaaagtattggagtttcagcttcagtatcagtctttccagtgaacactcaggactgatttcctttaggatggactggttggatttccttgcagtccaagggactctcaagagtcttctccaacaccacagttcaaaagcatcaattcttcagcactcagctttcttcacagtccaactctcacatccatacatgactactggaaaaaccatagccttgactaagtggacctttgttggcaaaataatatctctgctttttaatatgctgtctaggttggtcataacttttcttcaaaggagcaagcgtcttttaatttcatggctgcagtcaccatctgcagtgattttggagtccaagaaaagaaagtctctcactgtttccattatttctccatctgtttgtcgtgaattgatgggcctggatgccataatctgaggtttttcaatgttaagtgttaagccagctttttcactcttcctctttcacttttgggcttcccttgtggctcagctggtaaagaatctgcctacaatgtggtagacctgggtttgatccctgggttgggaagatcccctggaggagggaaaggctacccactccagtattctggcctggagaattccatggacagaggagcctggcaggctacagtccatggggtcgcaaagagttggatactactgagcgactttcactttcatcaagaggctcttcgggtcctctttgctttctgccataagggtggtatcatctgtatatctgagcttattgatatttctcccggcagtcttgattccagtttgtgcttcatccagcctggcattttacatgatggaatgttagtcaagccatatgaaaaaaactaaagcagtaaaggtttagtttctggtgtttgtcctggtgttcctttgtgtcgcccccttttctgtgctacattgaaatatttggtatactgtagttagttgtatctttgttcccttcttactcgtcttcctggttttgattctgtaatctctcagtttctagaaggacctctgctttttcaagatccatattccagtctgctgaaatctctgcctggattttcagtaggcatcccaagttaaattcagtatgtctcatcgttatccctgaaccaatgcaatatatatagagagagatgagcacagatgcctacttggtattttgcctgcattctccatcagagttaatggtctttgcatgtatttacaacaagcagcattgtataaggagttgactatatggtttatccagtagtcatgtatggatgtgagagttggactataaagaaagctgagtgccgaagaattgatgcttttgaactgtggtgttgggagaatactcctgagagtcccttggactgcaaggagatccaaccagtccatcctaaaggaagtcagtcctgagtaatcatgggaaggactgatgctgaagctgaaactccagtactttggccacctgatgcaaagaactgactcactggaaaagaccctaatactgggaaagattgaaggcagaaggagaagaggacaacagagaatgagatggttggatggcatcactgactcaatggacatgagtttgagcaagctccgggagttggtgatggacagggaggcctggcatgctgcagtcatggggtcgcagagttggacacgactgagcgactgaactgaactgataatcttaaggattgtgagctttacaatcaacaaattctagtccagacacattccctgggaatcatttgaaagcagatgtaatcctttttggtatcggctcaaaacagctgtgacaatctatgttaattgttaatatgattaaataagatgatgtaccaccttatacttaggcacttagtgttgattcaaaatcaacttcctcttgtcttgagttgtgccttctttagtggaataaatacccttcctctgtctgtctcttaaatggtagcacttaaatgctctcttgctggtttattgcctgagtgatagttatactgctatatggtatagtctgtactttaattttttaagataaatgatttaaatataaactgtagagcatttcatcagaagatggcactaatctgtcttgtctcctcagttggctggggttttttgtgtgtgtgttgttgttgttttttaatatggggagttccttactgtagaaataatcaagaatgtgggacattaaatgaatattcgtgctggcttangcttcagagaaatatgattctctaagcttttaatggccagaaaagtagttctcgctgttactcattcttgagattgtgtataaactctttttgtatccagtttctctgctnnnnnnnnnnnnnnnnnnnnnnnnnnnnnnnnnnnnnnnnnnnnnnnnnntttttgtatccagttctctgctttagatccagaaaaggaaatagaactgtagtaataaataactgtttcaatagcttttgtaacttagaaatgggcagaatatgcccttttataaactgtgtgctgcatacatttttcagtttgtattggagttgaaatactttaaatcgtttcttagtttctcattggtttatatagttttaaagattactgtctctagttgtttttcaattagtgagcatttattttcacggagaatttttattttgttggaaataaagaataatgacccgaattagataatgcctttttaaaaaaaatcagtctttgtgttagtatctttgtttttccaattctctgtattttagtattgttgttcttgttcagtcctaagtcatgtccaactctttgtgaccccatgagctgcagcatgccaggcttccctgtccttcacgatctcccagagtttactcaaattcatcttagtatcatttatcaaaaaattctacctttctctgcttaaacaaagtacgtttttagttcttatattgatcatatcttgcattgcatactttttaaaaaaattactgttaccactatctatagtcccattgtgtctgtagttttgaaaaactgcaaaaactctgttgccagagtattttgttgacaggtagggctatttattctggaaaaggagacttgttctttagggtacctttttagtaggtgtccagtaaagatagtctgtgtcttaggggttccatatttgaaattccagcattagttggagagaaatggaaatatgattcatgtaagactgataatgcttagaaggccctgaaacttatttcaaaatgtatttttagaagaatatgtatgcttatggttaaaacaaaaacaagattttaagaaagtagatataagcttcttcttaatgtcagaattttatctttattactctttatgggctctcattatattttggttgggtttaaattttaggggaaaggagtgtgcctgtgtggtttcatctcctgggactccctgattgttggatttactgtagtgaaatttgttaaatacggtgtcatttttattcctaactaatcaagaaattgtgaattcaagttttataatgacgtgttaagtttcttacctgatgtaatacatgtgtatctccaaatgaacatcagaattatttgaagtcctgcaaaatctcagtgaggttggatttgaaatattaaatattgagtcacagtattgccattttcagtataggaacatggtgtgtttgtttccattcaaatcagttttgagttcttcagtagggttttgtaaattttctgttatagattttgtcaatttttttttaccttttcccccttttttgctgattttagcataatcttttcccattctgttttcaaagtggtgatgctagtatgtaagaaagctcttggtttttctttaccagacaaattattaaacctagttttagaaattttattattcttttagttacaaatatatttgttgaaatgaagggtaaacctctaattttacttttaattaaaacttttttccttttttttttttaaagctcttttcacttatggatatgaaacctcccatctctcgagccaagatgattctcatcacgaaagctgctattaaagctataaaggtaagagtaaaagaaatatattaatttggaaggtgttttttaaaatgttgaaaatattattgttaaatttgaggtttcatattgtgaagtagttcaggcctaagtcaaagagcactaaccaggttttgctgaaagtacataataacaactgtatgatgtgtctacattgtaacatatttcaaaatctgttacgttgtatttcctctttatattttttaactttattgaggtatagttgacagatttagtagtaggtaatagagcacggtttgatgcacgtgtacgttgtgaaatgattaccttatactaattgacacatccatcacctcacgtagttaccttgtttatgtgtggttaagaattttttgagttgttgactatggattatttactagggttcgttcagtattaccttgagaattattcaaattgtacaaattttgaggttttaggtattttctaattagaggaaatgtattgaagagaaaagtgtgttagctggataatgatattctttttgttcttttcagctttataagcatgtggttcaaatagtagaaaagttcatcaaaaaggtaactatccattttattattacctcattttagttatgatcaatattgtaatgtactttgtgagttgtaatttgaataattacttcgaaagtcactctacagaaaagttgtcactggaagtcttgtttttttgtttcataacaaaacaaaaatatatagcagtactgttgattgagtacttactatgagtcaggattcgaaatagttttttgtctgctcgagccttctctccccattgccctgatgactcttttgacttttaacttatcttttagtacttcaaatgaaatcactgtggtgttttcaacttccctttctcccatcataattaaaccacttttcacttctacagttatatgttgtttgataacatatgtaacattagcacatgtctatgtcagtaaaggactgagaaaggagacttagacatcattgtcttctcccctaacctagagctgtaccttttttttttttaactgttttggccatgccacgtggcttgcagaatcttagttccccgaccagggatcaagctgtgccccctgcattggaaatatggagtctgttttccttagtataaatttttagaaatagggttgttggatcaaacaaggctttgtgtttattgctaaattatttttcataaaggttgtaccaccagaaatgtttgcaggtgtctatctattcattttatcttgtcagtttgtaaggccaagaatgactttgccttttgggttttgtttctctgatactgtactttaatagaattgaaattaatattttggttaagattggctttttgataattttaaaagttaaaagttattttttgagcaggatgaatgagaggagatttttccataataagtagatctgtatggaggtggcttaggcattgataaagtaatgctgattctaggaagttggaagtaggggaggacagagggatcagaaaaaagtaaaatattgggagtctgaaacatcaagagaatggtagttctctacagacctgtgggaatcttgacaagctagccaataagagaatttaacatttaagtagttaattacttaaattaataactttagttatttctgtagaaataaccttgaatatatagtttcataagagtgagattaatgggtgtcaaattgtgatttacttttcttgtattgacttacatctttaatctttgtagtgtaaaccagaatacaaggttccaggattatatgtaatcgactcaattgtgcgacagtctcgtcatcagtttggaactgataaagatgtttttgggccaagattctctaaaaacataactgccacattccaatatctgtatctttgtccatctgaagataaggtatagtttataatttttaaattaaacttgtattcttactctattcttaaatgtatattaggtatttaaagcctactgtattattagaaaggtaatcacatagtgatctctgtgaacttgaaacaaaacccagtttttttctatagtagtcatatctattttcttgtgaagtccttcagaaatgttgtacttttgaaatacaaaaggagcatcagttcagttcagtcgctcagtcgtgtctgactctttgaaaccccatgagtcgcagcacaccaggcctccctgtctatcaccaactcccggagttcacccaaactcaacgtccatcgagtcggcgatgccgtccagccatctcatcctctgtcatccccttctcctgcacccaatccctcccagcatcagagtcttttccaatgagtcaactcttcacatgaggtggccaaagtattggagtttcagctttagcatcagtccttccaaagaacacccaggactgatcgcctttagaatggactggttggatctccttgcagttcaagggactctcaagagtcttctccaacaccacagttcaaaagcatcaattcttcagcactcagctttcttcacagtccaactctcacatccatacatgaccactggacaaaaaaaaggagcatcatctttctttaaagaaaacattattagaaagatttcttgtgactgaatggtaaagaaattctgcagtagaggaggacagtgcttatctcaaattgttgtttattccagaaggaagggaccaatcattgactttccccatcatatagagatgttgaagtataaatgatattcattagcaatcagactactgtatttaattcctcacatttatagctggttttactctgtactataaaaagatagaaaaacatagacaagaaactagactctaatagataggagaaatacactggtaagctcagaataacaaagactagagcctgtataataaaggacatatgaattcgcatgttatggattctctgtattcttggaggaatgctcttgtgggaaagatatacaagagaagagttcattcctagaggaggagataagagttgtaaccatgaataacacattttctctggatctccttcaaatttggtaacccacaaaacaacttacctagcaattagaggccagttaattgtgttaaatattttaactattaaaatcatcctggattttactcttcttagataactgaattttttggtttctttgtaatcataaatatgaaaatttcaagtaattctaatgcatttcttttgactctctaggttaattttttgttttttttctctccctgtttcttaccctggattacactactgaaggaaggccagttagagtagtttaatgaggctgtaattctgatgatagattgttttctaacagatatagcatggaaatgttagcctgtggtgttttgttctctcttttcataagaggtataattatttatgctaatacttattatatattcatgttttttcacataacagagtaaaatagttcgtgtattgaacctttggcaaaaaaatggagtattcaaaattgaaattattcagcctcttttggacatggcagcaggaaccagtaatgctgctccagtaacagaaaatgttactaataatgaaggtaaggtcaggtgtgtctgtgcacttagagaattgtgtcattttttgtacatgatatgtttggaatctatttatagtgatggaatttttctataagaaggaaacttgagtttacatcttggaagatcaagttttcttcccatcattatttctaataaaagtattcagtgcgtgttgcagtataggctgtaataccataatctatattttttactgtatgttaaactgaatagagtattgttttagtaaagaagcttaatggagtttaaaggaaatatttatgagttaaaagtttttgaggccttaatgatcttttcttttttaggttcacctccacctccagttaaagtttcttctgaacctccacaagccactacaaactctgtaccaactgtaccgcagttgcccagctctgatgcttttgctgctgtggcccaactgtttcagacaactcaaggtcaacaggtaaactgtctatccaaagattaaatagtttgcagttaggtactgttgtcagttcttattttacattcttggttaccgagcacattgtgaggagggaatatatctactggaaaagtctttgtgaggaaggatactaggggatatgtgggagaggtaagcaagggagcagcacactgaggaatggtgtgcccctttggagagagctgcagagctctcagggtggtggagttgcccacagtgctagttacaaaattatatggattaatgcagacgatttttttacacttttttagaaaacatatatacattgttcacaattcagtgtattttctcttctctctgaccatcattgtctaccattggcgtcatcagcatatacttttaaccttaagtgacacacattgtatccctgatatatttattcaggataaacttaaccattactaaaaggttggttcctttttccaagttcctctgtgcctgtgctattttgattcaccattttttttttttaagtaaattaacttttgatactgtgattatcctttgttgtgtggtttatcagttttcccattctttaagcttcagcagatccttcagacttttcaacagcctccaaaaccacagtctcccgccattgacaatgccgtgatggctcaggttcaggctatcacagctcagttaaagacagctcctacacaaccacctgaacaaaaagctgctttccccccacctgaacaaaaaactgcatttgacaaggtatgcttctctcacataacccatcccattgtttatatcgctctgtagaagttaacccttttctgacttacttggattgttcatttagttatttgagggattttccccctcggcatcaaaacattgactcttattcttggttataaatgtgatatatattcattgcagaattttcaatataagagaaaagtaaacagtataaaggaaacagagcattcatcattaacccccttactcaaggataactactgtaacattctgctatatatcttttcagaattgatttcctgtggatatagtcttttcttttttggtcattatgtatctgtgtgtttgtgtgtatgtgtgtgtacatacatatataaaaataggtatttttaatctatatacataaatatacatacacattgtttttaactggtttatttttcatcttaatcctcatgtctctgggtggttgttaaggttaatagatataaatctactatgtactgagtgctcattagaattattccattacatggacacatcagtttaaccatttcccctgttgaaagacatttaagttgctttctgttttctgttgttgaaaacattagttaccttatctataatatgaaagtttgggttggtttagtgtcttcaaacttctcttttgggccttagttatgtttaaggagctcccactaagggtatgctgctgctgctgctaagtcgcttcagtcgtgtccgactctgcaaccccatagacggcagcccaccaggctctgccgtccctgggattctccaggcaagaacactggagtgggttgccattgctttctccattgtgtgaaggtgaaaagtgaaagtgaagtcgctcagtcgcttccgacttgtagcgaccccatggactgcagcctaccaggctcctccatccatgggattttctaggcaagagtactggagtggcttgccttctctgcactaagggtataggtgtgttgaaaatgcacagctcagagcttcctgttgaaatgtttgcctaaacaactccactcttacctgtttgtgtcttgtctatatatgacaatataaaatttaatttcattttacaagttgcagtacaaaaaaacacaaaagtttgataatcctagaaagaacttttaatttaatcatctctaaatatctgtttctttctagcattctaagatacaataactgttgctagtagttaatattaagaatctatggaaattactgcttgttattctatctatatgatttatgaatgactactgattaaaagaaggttggattaaaatttttgagtacaaaagaagtacatgcttttagggggaagaaatgcagataatacagaaagttctgaagtgaaaagggaaatcagttccactgatttgtgtatggtttttcagacctgtttcctctgcatatgtgaacataaattgttaagtgctatggttttgttttttagtcttctgttctatgttgtgattgggaaaattctccccacttgtattaaaaattctctatttctcctagtagttttacatttctgttttttatgtttgtctcaatgtatcaagaacttatattagcatacagttcaagatagttaaacctttatatttttggaaatagccaattctccctcacaatttttgtcatacacttttttctatgtctgtctctagataccattttgtcccactagtatctgtgtgtgttttggcatcatagcagtttaaacacttgcaacttacagttcatttctggatgtgttttctgcctttattctttttcagacattccttgcctattcttgggcatgtgaattggtatgttccagagaaacaggaccagttacaggcacagacacacaaaggggagaaggggggtatttttttttaagggattggttcatgtagttgtcaagtgtaagttagagtgtcaggctggaaatccaggtaagagttaatgctgcagtcttgagtctaaattctgcaaagcaaaaggttttcctgttgctgtcttgagaatgctgtctttgggaaaccctgctataaggcctttgactgattgattgaggcacacccatattgtggaaggtgtttgtttattcacagtccactaatttaaatgttagtcacttttctttttctttgctgctccatgcagcttaaaggattttagttccccaaccagggattgaaccttaggctcatggtggtgaaagtgcagagtactaaccactggatcaccagggaattccctgttaatcacatttttaaaataccatcagagcaacatctaggttaatatttgaccaaacaactggacatcataacctagccaagttggcacgtatacagttgaccatcacagcatgcttttccagatgagctgagtgttagcataaatttttatgaatttacaagttaatttaagaagtactgataatttcttatatagaatctcaatttactaggtttctgattttttttatatttgtttcatttattcttagataatttactcatttttcatgtttagtgtttcataacacttccatgtccaaatctttgcaatcctatggactgtagcccactaggctcctctgtccataggattttccaggcaagaatactggagtgagttgccatttcctcctccaagggatcttcccaacccagggatcaaaccggcacctcctatggcccctgcattccaggcagattctttacttctgagccaccctggaagcccaattgatgctgttgagggaaactattgaatttttatgttatcttgtaaattatcttgttttctctagttggttctctcacattttgtaggctgctaaatttgacttttccccttcaacatctagacctgtttcttttttttttttttactgtcttgatggctaggacttccagaaaaataaaatgttgagtaatagcagtgctagcagtggcattcgtattttgttgttcatttgaattgcaactaattcctctagtgttttatcttaagtggattgatcaatgtttgttctttacattaagtttagaaaaaggaattgtgctttgcttttgactgagaaggtctattttaagctagtcaaacagctgactgggaacagcttgtctatttcagcctctttgtagatgttcagtttccttaaaagcagcagaaatatctttttagatagtagggctcagttaaattttttaattgcttcagatgttttccccaagcaataggtttgaatcgtaaaacttttgaggaacatgtctatatgtgataaactgcatagagttcttttgttgtttttgtagatagtttaaacctaatttttttttttgttttttatattttatttatttttggctgtgccaagtctttgttgctgtgcaggctttttctagctgcagcaagcgggggctactctctagtctccttgtgttggcttttcttgttgtggagcacaggtgctaggacacgcaggctgcaggagctgcggctctcgggctctcgagcacaggcgcgttagttgtggcacacaggcttagctgctccacggcatatggaatcttcccagaccagggatcaaacttgtgtctcttgcactggcaggcagagtcttcacccctgagccgatcatcagggaagccctagacccgagttttaattttggctcctgtcattgactctattaatgttgagttacttaaatattcactgtatacctctgtaaaaaagcaatggtagtaccttttttgtgtgtgcaaaaattgtctgtgcgccaaagtcccttagaagcatgtgggaaaatgaaattgtacatcacagcatagcagggttatagatgatggtgaatgtctgtttttatcaagttttttttgtgcagtgaatcacaacctgaattttaaaacggaatattggcatacctcttgcagaagctacttgatagatttgattatgatgatgagccagaagcagtggaagaatccaagaaagaagatgctgttgccgcctcggccaccacaacacctgctcctgccgctgttgtgcccactacgccggccaccgccgccgcaccttctgtggctgcgcccactgcctctcctccacaggcacccttgtacgtcactttcttttgattcctcagcagatagaactttggtagtcattacaaggcataatgcaagtaacacttaatagtcatttttcatatagcgtcttctaaaattcttttaaaaattgtggtatttggggatttcttctgaatggggaggggatcctgtcagatttacaataaaaaatgacttttattttgggaataatgctgagtttttaagttaatataggtaaataaatgattaagtaaaatgttgattgttaacaactcctgaacagcaatctgtaagtttgtgtagcgtaaatgtggccaagaatgatgtgtttttgaatgggtaaaaagaagactgctcatctcttttagtgggtttcctggagatggcatgccgcaaccaacatatgcccaacatcagaacatggatcagtttccgcctcgaatgatggcagtgcagcaggatccagtgcaccatcaggtagaggcatttctaattacctaagacgtgttcattagcgcgtctgggttgcacttgccagagtagtagtgtttagttgtgtgggtggctgaatagtccttaagctgtactaaaagctgtcaagcacataactgatttgagttgcttttttgctttaattaaaacaaggatgctaaatattcatgctaataatttaataggtatttttatttaaatagtttagagagagattgttggttctattttaaggaactgagctatttagttatacaccttttccccttctgagaagcctttttttcccccgcttttcacttttatttattaatttttgtggtacactgtgttttgcaggatcttagttccccagccatgggttgaacctgtgctgcctgcattgggagcacagagtcttaaccactggactgccagggaagtctcccttttttttttattaatgttgtgtgacttgttgctttagagggctttcagctcttcagcagtcaggaatatagtttgaaatctgcagtataaggtaaggaggacatcatactggagaatttcaggaagttagactgtgtttgttcgttggatctattttaataaattctctaattcagagttttctaaacttgtccgtacatctcagttggaggaacatactacaaaatacatatcctagacttctggtgctatagtcaatcttagagaatctttatttattttaattatgtgatgattctgttgtaccaccagcctttgggaaatgctccttttagacttaatttagaaagtgctctaagaaaccttttagaatatattcattttcttatctgtatcatgttcaatccattatatataaaggcataccttgttttttcatttttcacagatcctgcacttttttttttttttttaaacaaattgaaggtttatggcaaccatgggttgtcaaatgattattggcattttttttagcaagatagtactttttagttaaagcatatacattgttttatttggatatattgcacacttactgaactgcagtaagtgtgagcataagttttaaatgctgtgaaaaccaaaatattcatgtgactcactttattgcagtattcattttataacagtggtttgcaatcaaatccatcatattttgagatatgcttgtatttggtcatatgaaactgacattgtgatttagtgacttgttgatcagttcagttcaatcgctcagtcgtgtctgactttttgtgaccccatggactgcagcacgccaggctttcctgtccatcggcaactcctggagtttatccaaactcatgtcttttgagtcggtgatgccatccaaccacctcatcctctgtcgtctccttctcctcctgccctcaatctttcccagcatcagggtcttttcaaatgagtcagttcttcgcatcaggtggccagagtatgggagttccagcttcaacatcagtccttccaatgaacacccaggactgatctcctttaggatggatgggttggatctccttgcagtccaagggactctcaagagtcttctccaacaccacagttcaaaagcatcagttctttggcacttagctttcttcatagtccaactctcacatccatacgtgactactggaaaaaccatagccttgactagatggacctttgttggcaaagtaatgtctctactttttaatatgctgtctaggttggtcataactttccttccaaggagtaagcgtcttttaatttcatggctgcagtcaccatctgcagtgattctggagccccaaaaaataaagtcagccactgtttccccatctatttgccatgaagtgatgtgaccagatgccatgatcttagttttctgaatcttgagcttaaaccaactttttcactctcctctttcactttcatcaagaggctctttaattccccttcactttctgccataaaggtggtgtcatctgcatatctgaggttattgatgtttctcctggcaatcttgagtccggcttgtgcttcctccagcccagcgtttctcatgaagtactctgcatgtaagttcaataagcagggtgacaatatacagccttgacatactcctgttcctatttggaacctgtctgttgttccatgtccagttctaactgttgcctcctgacctacatacaaatttctcaagagacaggtcaggtggtctggtattcccatctctttcagaattttccagtttattgtgatccacgcagtcaaaggctttggcatggtcaataaagcagaaatagatgtttttctggaactctcttgctttttccatgatccagcagatgttggcaatttgatctctggttcctctgccttttctaaaaccagcttgaacatcaggaagttcacagttcacgtattgctgaagcctggcttggagaattttgagcattactttactagcacgtgagatgagtgcaattgtgcggtagtttgggcattctttggcattgcctttctttgggattggattgaaaactgaccttttccagtcctgtggccactgctgagttttccaaatttgctggcatattgagcactttcacagcatcatctttcaggatttgaaatagctcaactggaattccatcacctccactagctttgttcgtagtgatgcttcctaaggcccacttgacttcacattccagaatgtctggctctaggtgagtgatcacagtatcgtgattatctgatcatgaagatcttttttgtacagttcttctgtgtatttttgccatctcttcttaatatcttctgcttctgttaggtccatacgatttctgtcccttattgagcccatctttgcatgaaatattcccttggtacctcttaattttcttgaagagatctctattctttcccattctattgttttcctctatttctttgcactgatcactgaggaaggctttcttatctctccttgctattctttggaactctgcatttaaatgggtatatctttccttttctcctttgctttttgcttctcttcttttcacagctatttgtaagatctcctcagacagccattttgcctttttgcatttctttttcttggggatggtcttgctacctgtctcctgtacaatgtcatgaacctctgtccatagttcctcaggcactctatcagatctagtcgcttaaatctatttctcacttccactgtataatcattagggattgatttaatttaggtcgtacctgaatggtctagtgattttcccttctttcttcaatttaagtctgaatttggtaataaaggagttcatgatctgagctacagtcagctcccggtctggtttttgctgactgtatagagcttctccatctttggctgcaaagaatataatcagtctgatttcagtgttgaccatctggtgatgtccatgtagagtcttctcttgttttgttggaagagggtatttgctatgaccaatgtgttctcttgacaaaactctatgacttgttgatagatgaaatttaaaaaatattttctcatcctgtttaaaatacaaatgaaacctatgaacttaattccaaatgtttaacaattattgatagtttattaataatttagagagactgcttttttatattatagtgatattacactataattgtataattgtattggcattagaatgttaagtgtataaaattgttagattgtgaacatagtactcttattataatgatatttcaaaccctaaataaattcagccgtaggcatgttggctgaaattccccttggagtaaaacttaaaacaaacttagaagtcagtgcttctaaatacttttcctcccctaaagcttaattgcctttaaagttgaagagagaatatttgcagtagagtacctctgattttaagtttagtctgtcacattgctttctcatataaatgaaggtatgtttttataaatgaaggtatgtttttaaattataaaacctgacatttgtgttaattttaaaatgagttgtaggatttttaagctgtgttcttggatataagcagtttctttggataaaaattgtatatgtagaaattgttggtcatggttgaatgtcatagtttttccttgatcaaaatttattgaagatgttttagttttatataaagttaactaaaattttttaaaaattatttttggtagcagttacttaaaatctactcatacaatttttttttgttttaaaacaaacaaggttccacttcctcctaatggacagatgccaggctttggccttcttcctacacctccgtttcctcccatggctcagcccgtgattcctccaactccacctgtgcagcagcccttccaaacttcctttcaggcacaaaatgagccacttacacagaaggcacatcaggtaaagcttcattctccggttgctggttattttttggttcccttgatttacaagcagattcctgactgtttgttggctttctatcttcagttttgaatatgaagaaaaactattaactgtgggaatatattcaccttttctgtgacctaacttattcttttaggaagcggacataataatactataaattttcatagggttcatgaggattgagatagagtatggaatgcttaaacagtgtctaattcattgcttgaggtgatggtttgttaacacagtatgttaactttcacaaaataatttccagaagtagataagtatttcttctttgtttgtgagccatatgaaaaaaacttttcccactcatgcccagtcatcattaagctagtaattaggtctcaagtaatcataagagaactttctgggcaagagatttgtaatttagcattttgtaagtttttggcctctttttttctatttataatttccattttctcctttaatgatgggttttgtattttgtttttctttttaaaggaaatggaagtagaacaaccttgtattcaagagcctaagcggcacatatctgatcacagaaagtcaagatctagatcagcatccaggtagtttatagaaaatgttaatccagatgttcatgttttgagagacttagtatttaattgtttttagatgtatgggattaataaaataacacttggtatgtttgtatgcatgagtagaatgggggcaggagacatattagttttaaaaaactaagtcattttagccagtattttttccctctgagtttctgtaatgcctgtttacagatatgcatggaattgtaagatttatgtattcaaagttcctttaccaatttatcaagccaaaaaaaaaaaagtggaaagaaagtaaggaatactgtaatcagatcacatatttttaattgctacagaaaaaaagacttttctgagaagatagagaatagcaatcacagtatatctctgtgatgacattagctttttcattacaaagatgtcatttaaaataatactagaggtatcaaagatgagagatacttttttataagttagcaaacttgtttataatatatatgtgctttctaactttgtgcatattaaaaatccttaaaatgaattccctactgtcaaattcttacacatcttacaaattcttacatatcttacattaaattccctagttgtatttttttcttcttgcgattaacacatgctgaagttttctttatttccgtatattaatccattctcctttgtcctgaaaatattaggtcaccgaaaaggagacgatctcgatctggttctagatctcgaaggtctcggcatcgacgttctcgatctaggtccagagatagacgccgacattctcctcggtctcgatcccaagaaagacgagatcgagaaaaggaaagagaacgccgacagaaaggccttcctcagatcaaagcagaaaccgcaagtggtaagtgaacatttataattcacatttcctgcattttttttttcatttcataagttttaaatgctttgtaaccacttaggaaaatactgctttcttgggtcttgtctgtttgtactctggcgtatacctttagatttgcttttgtacctatagctggctgtgaatcagcaacgagaagtgagccaaactaacagtgatatgtaatagtgtgtcttgagtcaagtgtataaaatatagttgttaactagttctgcacactgaggaaaggtgggggtgctcctccagaacaactaataccctcttactttataaagatacacaatttatagggtgtgttagcttgcattatctcctgaatttcatgatgtgtttagaatatgtttaataatatatagtagatattcttgatataagtctatagctgttaatgaaattttaattgataatatgacttgggcatatataaaacttctgactctgcagggctgattatctaggacacagcatgaaacaaaaatcattacactcgacagttgaaaagggacagctacttacagtgaacaaaagcactgaattggttggtgatcaaggtctttgggatcaaggctttaactcctttgttcacttgccaagggcattcttgggcaagatgctgcttctctgactctttacatagatgaaatctttagatgtgtcttcaaaagaccagttttttcccacctcatcggtttacctttcactatcctggttcctagaatgtcgacattcactcttgccatctcttgtttgaccacttccaatttaccttgattcatggacctgacattccaggttcctatgcagtattgatctttacagcatcagaccttgcttctatcaccagtcacatccacagctgggtattctttttgctttggctccatcccttcattctttctggagttatttctccactgatctccagtagcatattgggcacctactgacctgggtagtaggtcacatgctagtaaagtaatgctcaaaattctccaagccaggcggcttcagcagtatgtgaaccgtgaacttcctgatgttcaagctggttttagaaaaggcagaggaaccagagatcaaattgctaacatccactggatcatggaaaaagcaagggaattccagaaaaacatctatttctgctttattgactgccaaagcctttgactgtgtgcatcacaataaactgtggaaaattctgaaggagatgggaataccagaccacctgacttgcctcttaagaaatttgtatgcaggtcaggaagcaacagttagaactggacatggaacaacagactggttccaaataggaaaaggagtatgtcaaggctgtatattgtcaccctgcttacttaacttatatgcagagtacatcatgagaaacgctggactggaagaaacacaagctggaatcaagattgccgggagaaatatcaataacctcagatatgcagatgacaccacccttatggcagaaaggaaagaggaactaaaaaagcctcttgatgaaagtgaaagaggagagtgaaaaggttggcttaaagctcaacattccgaaaacaaagatcatggcatccggtaccaccacttcatgggaaatagatggggaaacagtggaaacggtgtcagactttatttttctgggctccaaaatcactacagatggtgactgcagccatgaaattaaaagatgcttactccttggaaggaaagttatgtccaacctagatagcatattcaaaagcagagacattactttgccaacagaggttcgtctagtcaaggctgtggtttttcctgtggtcatgtatggatgtgagagttggactgtgaagaaggctgagtgccaaagaattgatgcttttgaactgtggtgttggagaagactcttgagagtcttcttgagacttgagaagacccttggactgcaaggagatccagccagtccattctgaaggagatcagccctgggatttctttggaaggaatgatgctaaagctgaaactcctgtactttggccacctcaggcgaagagttgactcattggaaaagactctgatgctgggagggattgggggcaagaggagaaggggacgacagagaatgagatagctggatggcatcactgactcgatggacgtgagtctcagtgaactctgggagttggtgatggacagggaggcctggcgtgctgcgattcatggggtcgcaaagagtcagacacaactgagtgacggatctgatctgatctgatcctggttccatttctggaagtactactgtaattttctagaatttttaaaacttatatggggttttgggctttccaggtggctcagtggtaaagaatctgcctgtagtttcaggagacacaagagacctgggtcatgaagatccgctggaggaggaaatggcaacccactccagtattcctgcctgggaaattccatagacagaggcgcctggtgggcaacagtccatgggatcaaaaagagtcgtacgggactgagcaattgagccgtagcacatatggtgctttatacttaaacttgtggatatcataatgtaactcatgcatgttttctgtaatgatttttttcatgtaaagtacagagctgctcagtatggaatgtgtatatttttatgattataattttattttaagtttgtagtactacactctgggtgggacagctggacaaaaggactactcagcaggatgttgccagtcttttagaagagtttggtccaattgaatcaattaatgtgagtatttattaaatttcttaaccacagtagatagaagtggttaatgttattttgtgaaattaaggacttgagacctaagttaaaattggtctaggtttgtagaagatgtggctggagttgaggtgtttgttctaagtttttgtttagcatttaagtacattttttggataaccaaatttaatctaaaatctttttctaaaaatgactttatataacaaagcttggggctgtagattgttgatgattggcagttgagactaaattggagccaccagttttcagatttttttaaactccagttatagaacacagggctctggagtgtgtaggggattggaattgaggttgttggaactgactgcttaatattatgtcttgttgctttttggttttgttatcatgttttataatattaaatctttttgagcagatgattcctcccagaggttgtgcctatattgttatggttcataggcaagatgcctatcgtgccctgcaaaaactgagccgagggaactacaaagtgaaccagaaatccataaaggtactgttttatcatttataattcattttttaaaaaatgtaacatatattatgagacttttaaaaactgtagttttggacactggggtattattacatgtgcatcttttttttaagaggttatctcctaagagttacaattttaaacgctaggtatatggtagaattttgtctttttttttttttaagtttgccatctcagaactatgaaaaataatcactaaagatagagggaaagatataggtacatgggtgttcttcctctgaggggtcagagtcagtgtttccttcaagtcccaaaaccctgttccacacttggatttcactgcaaaaggattttgtctaatgttgaataattctgatgtacccaagacttttaaaagtgttccctactttcttatgcccaatcagccagtccctgataaaattttcccttttctcttagttttatgctgtctgagtaggggtgattggaagagtgagaaagaaggtcattgacagtcagatttccttctaggacaaacaagagtgggatgaaagggtaaccagattcctggcgccaaagatgctttgagtgagccccatgggtagccaggccagattgttcccttgctgaccaagtctgagtgattggaatcatgggaaacagtttatgacattcttctcctttcctttttatattttaacaaatgttgaactagattgcctgggccctaaacaaaggaataaaagcagattataagcagtattgggatgtagaacttggtgttacttatattccatgggacaaagtcaagcctgaagaactggagagtttctgtgaaggaggaatgttggacagtgatacacttaatccaggtaaagtagtatttaattttttttaatgtatttatttccttggtagtactatgacaaatgtttattctttgccttaggaactgttttttgagatttttcaaatacccactatgtgggtgctagtctctccattataaactaagggagcaatggtgaataagacaaatgtggcctttgcccttatgcaacttacatttagtgggagagatgcagacacaaataattactgattgtggggttcattattcattataatattaagtggatcttaagtagactttttcagtgtaaaaaactaacagatcagatgagtcttaaactgaacattgttagtaagatccactgcctcataataatttctttgaaaatgtttaaatgtccagagaagccatcaaaagtaaacatgtaagatgaggagatgcagttatttgaagcctggatattaaaaatgccaggttgatagtggaattttcattggggaaaatgccagcctgtggggacatgacctggagaaagagagatagcaggacaaagaggagcacaggatggcatggcaaaatagagtaaatatttcacacattacagaacttcagtcaggagtgcagagctggacttgccccacataccacctcctccctgcgcgtgcacagcgccttcacttacggatagagctaggcgtttctgttcaggcagacaggtgttgaaggtctgtgctctaggtgttctgggcgtctctggtccaggataaaaagaactctgctcctccttcccagggtctttgatccaaagacatcctcctccaccattgtggttaagaacagagacttaagagccagatgtatctgggttgaatcccatctctgcctctgccaagcgtgtgtgactttgttttcctctcataaaatgggaataataataaatagaactattacatctgtgtatatatgtatgtatgtatgtatgtaacaaaggcttacattttcagtttataattttaaacgcagaaatgattttttttaatgttgatgatattaaaatcagagagctttctgattatatttctttaactcttcatagattggaagggaattcccaagaagcatgaaaacgaagttgctcaaaatggaggagctgaaacctcacacacagagccagtgtcacccacacctaagcctctgcctgtgcctgtgcctcctattcctgttcccgcaccgataacagtaccgcctccacaggtaagagtacttggggcattgttgaagctttcaagcatctaaaagatacctttctaaatcttactggtgatgtatgtctagattcatagctaaaagatgtgagtacatacacgtgcgtattaatttcttatatattggtatgtcagacctaatatttataaatgctttcaaaaaccagagtaaatttcattttgccttacatctgcccagattattcagtatcttattacctcataaactttttgacttgaaatgtgattttcctgctacatgttaagagctaagtaactaatgtgttggtaagaattagaagtacttgatccatactttcatgtgtgattcactagatttttctcttctttcagtaccttctttcctcagtttctcacattaaaactgaataagtaaatctaagctatctcagggctgggttgcctagcttcttgattttcctcaatgttaagagaaaagtacatgctttggtacattcttagcggtgacattttataaatggattccccaaattggcactccttacgcaaccttttggatatgacttccagtgcaggtttcagtgtatgtcagcgctcacttaaagaaacttgacttatctgttaagattgatacttttttttttttaagcaataactaaagtgttgggtatgtattaaatgtcaggcattagcactccacatttatttattctctaatctccataattatgtgaggttggcactttttcatcttacagatgagtaaactgaggtctgcagagtgtaatgtaagtcgctttctcagggtcacaaaatgacttaaaagggggaacaggcagtttgaccccaggaactgtgatcttaatcacagttaagtgcaaattacctggtagcttttcttagagttgtattcctcaaacttaattgacctgaccgtgagacatttttttaacaatattctggcagaacaccagtgtaggtgatggtgaatcacagtgtggtatttgctttgataagtatagggcaaactgatttctggaaattccttggtagctcagtggttagaactccatgctcccactgcagagttgcagcttcaatccctggtgggggaacaaagatcctgcaagccacatggagcaagcagcccagaatttttagaaaaggggaaaagtatgtagtttccattgttttggagtgggtacagattaccactgttatctaataaatgtattcacataataagcacaatttagagatactggtttttttcagcaaggtattttctttgtctctacccactatatgagtgagagggtggctagatacgcggcttcattttcctttctttctttctaggtcccaccacatcagccaggacctcctgtagttggtgctctccagccacctgctttcacgcctcctttgggaattccacctccaggctttgggcctggtgttcctcctcctccacctccgccaccgtttttgcgcccaggattcaacccaatgcatctgccaccaggtacactaagttatttgagaagatactctcttttaagagcctgaaataaagtgacacaacttaagttggcattgtttttcttattctaggttttcttccccctggacccccacctcctataactccaccagtatccattcctcctcctcacactccaccaataagcatcccaaactgtaagcatgtttttcctttgtcacttgtcctcttggagttgggagtaggagggagaatggaccagtaataggttctgtagtatggcaaaagcatgttaaccggggtgataattaattattcagcttcacatgttgatgtaattatattccttagctactatcgctggtataaatgaagacactacaaaagacttatctattggaaatcccattccaacagtggtgtctggggctagaggaaacgccgagtctggtgacagtgtgaaaatgtatggctctgctgtgccacctgctgcacccacgaatctgcctacccctcctgtaacccagcctgtttcacttcttggtaagttcattttttttatcattagttttctttccccttcccaagttaggctttttagaaacagtgttcattttggtaaattattctctgaggctattttccttggaggaagacctttcttttaaatatgtgtacatggtcttcaccaagtctacccttaagagacagcctcaaaaatgaaatcttatttgtttctgtcttaaataaaactttggatttgcacatcttaatttggtataaaaaagtgatcagactaatctctatgaacaggaattggtacatagtccatgattaacagaaccccagacatcctggcatagtaagatacagactttttttttaagcaacataggttttttttctgtctggatgaatttttatatatttaaaattcctggactttgataccattctctgtaggctggcaaagagactatctttgatacattgcaataaaatggctttgttacctgagtgacagttgcacagcctgaggcagtgctttcccactgacccctcagtttcttataagacttaacctgttgtattctttacccacaactcaacttctaaggtccaagaaagtgtggtttagattgttcacatctttaagaggccttacccttgcttgcttgaatttaaatgatatgccatatacttatttcaagtgttaataacaaattattatatttgaagtggtattgctaactataattaacacttgattctgataatgggtagttaatttatccttactattgtaatgtttcaatcctgtgaactcattgtattttttaaaggtgtgtgtttgtgcacaaatgtttgttttcctaatcttagattttttaaggaaagagccctatactcctgggatatagggctgtgggacattggtttgtgatgtaggacttttacttttcacctgcagttttcaggactgttggaaattttactttgttgcatgtactacatttataataaaagttaatttgtttttaaatggcatgctgtcttctgccctctccaagactgaggttaggttaataataaacttgatttttattttagtacacagactgagtaatagtaaaagaggatttatggttaaaatttgtcacaagtagtgtacagtagtcattgtaatgatgcaaaatgatttgtttgatggggaagttgcttaagaggtctatgccctgatggaagtcaaagtagaaggaacagtagtagactgggagccaggaaacctcagtatctttggatctcagttttgttaaaaaccccctcccccccaatatttgtaataagatgattatacaagaatcatagtgaatctaagttgggtagaattttctgatcaccctctttcctttaccccacacccatgcccctgattatgaattctcactgaaatgaaatttcctactctggtgtccatagatattaatcacctgagactgtttgcttgcatttgtgcttttttcctgggtttagtaaattcattaaatcagtgaaaagatttcatcatctctaagactttgataaccactacttttgaacaaccttcaagaataaataacccagggagttcccctggtggcctgatggttaggattccaggctttcactgccgtggcttaggttcagtccctgggctgggaaccaagatcctgcaagccacatggcacagccaaaaacaaataagaataaacagcctaccttttatttaacatttaggctttggaaactctgcccttaatttctcatcactactgaaatgtataatttaaactctcagccaacatgtgaaacaaaacatatcaaagctagtcagtgctagaaaaataatcaaatgtcttagcattttttgttatgtaacatacctgcttagatgtccatctcctcctacccaccagactggaagctccatgagagaggaacatttattatgtaagtggatggatggatgcttttcagtgtagggctgtttatacttcacctctgacgatgatctttgtccttaacttttaaaacaaaaaatttagggaataaaggttgttccagatctggaaacattaaaatctgatatagcataaaaataagaacagttttgttaaaataagcacttttaagtaaaatgcagtagttttatttgaatcatgaaaaaaatatacttgtttcccttcgattagaaatcttgaaaagagtatcccatgaattttgaccttttatagaagtgagactttttaatgtatatgcaaataaaggaggatttatccaaaagactgatcacaattccatcattttgataaaggaatatagtaatcacatgcagtattgtagtactaaaggatcaattaagtaggttggatactgttgatgtcaaccatgaaacagaagactagagctaagatgctttcatgttttctcttggtgctctaatgttttctcttaagataataaaaaccaacatgacactatacagaaaattttaagcctaggaggtgatacttaaacttcagcttcttcatctgtgagacaagaaataaaaatgttaaaccagggtgttggggtgattcagttggactaacataaacatatataaacagctgacatggggcctgtcacaaagtaggcactcagtgaatagtgggtgcttattacaggtaagaaatatcatagacaatatttagaataaagaagagtatttatacttggaaattctaaaattatattactgtacctataatttattttaaattgttctaattgtcagcagtagaagtagcttttttaggaaagtatgtatcttggcatggttgcctcagatatttttacagtatattaaaccaggtgataagttcacatatatagaagttccatcatggcttagtgataaaatgtgtattggttatatagtaatggcatttcatttaaatagcatgatatggtatctgtatttatcctattagtgatactcaaattgttttcttaaaatgaaaggtaaatatatccttgagagttaactgagttcttggatcttaatttctgaaatgtggcaatgatatttttaaactagaggggccagtaaaatgttcaacagatcttccaaaattctgttgtgggccttggttatgaaggaggcagtggggtgctttaaggatggtttggtttaaagagttttctgaatgatcagacttaagtttaggtgttagtttggaagtgatgactctctggaattgggctgaagtagcccacaccaccagatttgtagagaaccacctccatcttctagagatttttattgttttagtaaccgataatctgaaaacgtaaaaactatttgatgcacaataataattcattacttgattttaaaggaatctgtgcttaatacctcacactcccaagtagcttgctagagcagtggtcatttcattaaagttaataatttatagttgttgaccatttagaagagaaggaatattaaagatgatagcaattcagtacattctctttactgtataagtgtatgtatttattacttttccaaatttatgtataacatgtatctctaatacaatgtacaacatattcttatttaaaatttcattgtaatgtgaaatttgggttactttggtgttccaaacaataaaaaaatacacaaaaaaatgtttgtttgtgttacatatctattgtgttaccagcatatccaaaatatcttttcaaggaagaaattaagctaagtcagactcattcctattgtgcaaaattaaagtctcttctcttgtcaggtacatacattcattaattattattatacagagattctccccggttttgtcacagtgctataaatgatggtaaacttcataagtaagaattgggtatgtgttagattgcttctttttgataatatttgttaccaaagatttaaagcacaagtcacagatcagtggcctacaagctgaattgctagacagtagtatgatgtatttcgagcttgatttttcacacttccttgcctggcatttgattttccataatttgaacacgtcaagaattatgtagaccaaattggtttgtaaattaaacagttatatttgcttttatgccatagctgtgaccttaatactgtcttgaagatgaacaattttattgtcaacttctgtaattccacttgattcttgaacagtgctgggattaggggcttcaactcccgtgcagttgaaaattcacttttaattttatacttggccctcagtaaccgaggtcccacatctgtagattcaaccaactacataccctgtagtatgtatttactgggaaagcagtctgtgtaagtgggtctgtacagttcaaatctgtttttcaagggtcaactgtgctttaaaattgatattttaagttgtgatttcacttagctttacagttttctccccagaattttgattttttgataatttttaatattgtaaattagaacattagagcaccaatctaatagtgtgaataacatttaaaggaattctgaagaaaattctcaatatttttttaatggtaatgtctaatttttaaaacacttcttacattttaatttttttcttattgtagacttggttgtgatgttggttatattaaattataacctagaggggtctaccaaatgttcctttgtcctgtaaaagtgttctttgaaagctttaacatatttgaattggtactctaaatattgcgttttattattccactagtgttttatacttagaaatgcttccaaaatactcatcacagtgcttctttcaactttgtataaaaaacattgttcaatgaatgactaatagtgatcaatccacaacaaatacttactttgggtatgaatttatacatgaatatactgtgttttctcagaaggtgaagcacttcaaacaaaaccttggcaaagtcttgcacaaaaacgtgaaaggtgcttatcacattgtctccatctctgtctgcaccttctaggctgcagaactccaacctaaagagtctctttttaattgaaacctgacagcttttggggcctaaggaaggtaggagggacagaaactctgggctctagattgatttttggtagacaagtataatgctatgaagaattgcaggtaagattttttccagataacactgagaattatggatgatctcattcagtaatggattaccagtatatcccagacttcttgactccagtagtacaactcttaactccaagtcacacctgttatgcctctgtatacaaactcaaattctaaaaaacaactataaaagatctataggaaaattgaccaaaccttattgtagattgttttgcaaaaaaaaaaaaccaagaagtcatttttaagagataatggtttctgtttttttcatttaaaattagggttttcatgtcctatgccatgctaaaaatagatatacggcttagtgtacttacactatattactgaaactcaaatttcttttaagtttttgctaacataccttttttttttttttttggtgtagtaatgtataatgcaatctaacatgtgctctctctctcattctttgaaaactagctcatttttttcattctccccagctcccaacacagtacctgctagaagaatcacctgggagtctcttcagaataattatgccctaattgttattaattggtgaatctaggcaaaggaaatacatgtttgggttgtactattatttcaatttcctgaaggtctgtagtttaaaagaaaaaagacagctttcaatggttcaacaaccatatatctgtatgcctagaggctctcagggcgttgatgggagagataagagtggctggtatatctttttccttgtgtgaacagatttcgaattaggttcatgcacagtgccacagtggcattcttttggaatcaaaaaaggtggaactgcaactgggagcggaaaaggaggttgtgaaagaacattgcagcttttctcaaaataaatttcaggtcttcataggtaaggaaagagaccaccctggggagagactgtttttgccccctgagaggtatcttgtctatgagtttagttgtcggtttatgccaccaccatacattcatatgttctacatgtttactcccaatacctactgtggaccaggcagtgttctgggtactagagatacctgaatgacaagagaaggcctgtcttcctggagcttacattctagcagggacttagataaataagtaaactaataatttcacatgaagatattcctgtgaagagagtaaagcagagaatgggattggaggaatgtcgtgtaaagtgtactgttttgaataaaatggctggagaaggcttctgaggaggtaatatagagagaaataataagaggaaagagtcgtgtagatacagaggaagaacatctcatttagagaagacagaaggggagcctggactgagaacaaactacagagggctgtagggctggaacaaggtgaacataagagcagccgtgatgagttcagagctagttaccaagggtcagtcaggagtgcaacaggaagtgtaggtttgaacactgttgtgaactagtttccatttttcaaaggattgtatatggcagttctggagaaagcaaactgcaagagttggtaagagtggaatgaggggactattttggatgaagatagagccttcaaagtgactctcctaacttacatacgtgagagaagagccaagaatgactacgttttgttgttttttttttttaacctgagcatttggtagtgtaatcgccattcctgaaatgggaaaatctcaaagaggtgtgggtttagggtgaggatgtcaagttaaatatgttggatgttttgacatttaggtgcagatgtcagctaaacatctggtaaagataagttctggtgttgtcagcaaatataaacgacatttacagccaccagtcgtgaaattacctagggaggggatgtagtgcgagggatgagcccaggaatactgcagcacttagcagttgaaaatacagtatggagaactaagagtttgtgtatatcaatcatttaagccttacaattctttgaagtcgacacagttatccccattttgtagatagagtgtaagaggcataaagagatgaaataacctgcccaaggtcacagctccaagtggcagtgcctagaattcaaggtaccctcgttccaacacccatgcttttagccactgtcctgtgctgttccatccagcaaaggcgcagccagggagctaggaaacagtatagggaggtactctggaagctgannnnnnnnnnnnnnnnnnnnnnnnnnnnnnnnnnnnnnnnnnnnnnnnnnggagagaatgagagagaggaggcaatggtacagtaattctggacatcctactctgaggagatgtgccatatgggggaacattaaaatgggggtgagagctgaagggagatccacagtgagggagggtttttttgtttttatttctaaaagatagacaaaactccagcatgttcttactggaaaacccgggagaggggaaatttttgatgcagcaaaaaagatttgctaggttgatattcttaggtagatgagaggggggcctagatttggggtttgagtgtggggcttcatttagcctttggaacacatgttccaaacagatgttcacagacggaaggagcaatacggatacaggtgcaggtaaagggtaggtttggtggtaggtgggtggatgaaaaagtcttaataaatgccttcttttaatgctataccaactaggataaataaaacttatttccatttaacattacttggttatgaaatgaagtactttggatgggccttgaaaggatacgctaagtcaaagaatctagtcacagagggtcgtgtattgtatgattccacttacatgaaatgtccagaatagccgagtccatagagacaggaaatgggatgtatggttgcctggaggttggggggagatggggaatggtagttaatgaatacagggtttctttttgagatgataaaaattgttctaaaatttattttgatggttgcccaactgaatatatttaaaaacattgaactacaccctttacatgggtgaattgtaggctatatgaattttacctctcaaaagctatataaaaccaaccaggtaagagcagacaattaaggaaaaatgaacatttgaaacagatacctagaagcatatgaatgtgaattgactcacgaaattagaattggtggccaggattaagggagaatttgtggttgtagttacaaacaaaatgaggccagtcagcatgttgggggtggtgcccagccgtcttcaggtgcagattaggtagaagtgttgcatttaaaaccaatttctgagcagcatggtgagggagaaccatggactcccaagacaggtaaggaggaaaggaaagacgttgcgggcatggggaacatgatcctagtgggattgaccgttgtttggggcacttgaaaatgagaattttgaagtaacgaagttgcttctgatgaaaagtccaggacttcccagaggcattggctgtggtagaatgaaagacatgatgattggtggagaagaggcagaagaaccatcctttctgctgattggccttttcagatgttccctctgcccttcctccccttgctttcccccctttccttcttcacatagcagatccttgctttaaaaaaaaaaaaaaaaaatccaacttaaatttacatcatctgtgaaagaatacaactaacacattcagctggtctccaccacagtaaataagtcaagctttattcttctgagatttcaaggtccacactggtctctaaccatatcaaccttcccctcccacaccacccctttagccttttaacatacttgtttcttatttcccatgatcaccaacatctttgctatagaaagcagtggcatctctctaatcttgatacttgttttttagttgtggaacagttgagggctttttgactcataggaaatagccttggctatttaaactccaatgagtttcttgcccagtggcttggacggtaaagaatccacctgcaatgcaggagacccaagtttgatctctgggtcagcaggaccccctggaggagggtatggcaacccactccagtattcttgcctggagaattccatggacaggagagcctggtgggctacaattcatggggtcgcaaagagtccgacatgactgaagtgacttagcacacatgcacgagtttcttctactccttgaatttaaataatttgtctgccttaaaatcttgctgcattagaaaatttggagttttctatctactgtactgtctccccaggtctgaattcctcccttttttgtttcatccatattctggataagttaacaccatgactcttaatcttctgagctctatacatttaatcaatctcttgagcacatttccatcaggtgtagcccaggcctctccaaccctcagtgttaccatgtgaagtttgtcgtctgtctccaaaaattgcttctgttattaaatttctgcattgcacagatgcctccatcctcgttcaaagcagagagctgtgttcctccagctcttggattcttccagtcctgctgttgaaaagcttaaatgttcctccttctctagcacctctttcagttgtctatcacctctgtcccctggattcttgaaataagagcctcactactctctagtatcctccctcctcccccttcttgctttcctgaaagagggatcttccgaaaacgaacataggaccatccctgctaaaaatccctgtgtggttttcccccctctctagatcagtccaagttccttatcacgcatggaagacctggatgccccggcctaccttgttcagcctcacacatctcatctttttttctttttctaatttgtaattgatagcgatttatatttgtacagattgtagctgcttcaataataaacctcaccttctctcctcgattttcattcagaagacattctgctgcagtaacagcacactttactgcttcagcttgctaataggccttttcagcagtgccatcctcttgatcgtaacattcttcattcctaatgttggcctgaatgtttttgtcttctgctgacacctaattcagacatctcatgggactcctgctcattttcacacacaccgacttgtatcagttttacttttgtcaccatcctagtgtgtgccatctcttagagcagttaacatttgtttctactaggctgtattctgtttgaaggaaaagattattaattttagtccttatatccccagcacatgcttccctggtggctgagtgttaaagaatccacctgccaatgcaggtttgatcgctgggttggaaaattcccctggagaacgaaatgggaacccactccagttttcttgcctgagaaatcccatggacagaggagcctggcaggcaacagtccacagggtagacacaggttgggacacagccactaaagaacaacatccccagcacagtaaatgtggtaacaatgtaaaaaaagcttcgaggttcaacatacgtatgggtgaatttttttttttttttttttgaagtttgtaactggaaaacttgtccatggtatattgcacatcaaactttgaaataaaatgaataattacgttgaatgtcctttagacctggggaactcactacatatccactggtgtgtgtgtaacatcagctttcctaatgaaaatgaaattcagctgttatccctaccaggaacttacaccacctgatatatttttttaatcaaatgtaactttaattaaaagcagtacttttttgttcactgcagaacaacaacagatgagcaaaaaaatcagtaattctaccacttgtgtattttgaaggccaacatttgaaactatggaaatactgtcaggggagtctgtactttgttggcccataaagggttaaagggaaatcagcttatttatgaaagagaaaaattatttgagtgtataatattttaagtaaatcctaaatatccacatatgttagatagataaattaggcaatgggtttttttctttataaaaatatgctttggggaattccctggtggtccagttgttaggaccctgcattcactgccatgggctctggttcaataccttgttggggaactaagatcccaaaagcttcatgtcgtggccaaaaattaaaaataaataaaaatttatttgtaggaggtttcattatatgggacttccctggtggtccagtggctaagacttcactctcccagtgcaggggcttggggttcagtccctggtcagggtactagatcccacatgccacaactaaagacctggtttgacaaaataaatattaatatatacatatatatatatatatatatatatatatatatatgcatgtactgtaaaagttaaccctgttaagtccgtctgtatgtaccctcagatgcatgttacaaagaacttagaaatgcgttcctagagatgggtttagaaagaatcattgcccatgtgatctctgtacaaagatagaggttggcttttggcagctgtcaaattggcagttgaggaaggcgtcagtattcccattgtcctgcaaaggtctgtttcctcttaaagattcatctgaacttaattcttttgttataataagatacttttaatcccttccccatccctgtagtgtaatttattttttttttgtagtgtaatttaaaacttggtattggccccttgagcttatagttaggtcctagaatgtgccacaccaagtcttttaacagagtaaacatttatcatttttttccttgagtaaaagctggtgggaaatgaaaattttatttaggtgcttctgtatatgattaactattgaaagagactgtacatgggtacatacactttatgttgcttgttttgagttaaagtccacaagtgttggtactgtatgatttctttaaaaagtgggagcaaggaaataaccttagatgccaggttgtctcactatatggtccagtctcagtaaatgtacaataagtggcatcaagaaagtttgctgtgaatttcatatcattctgaggtagagtataagttctgtgttatgctcattgtctgggattttcttaagagtgtgaagagtgtatgaagggctgaggtctttgcctcattcatccagttcatcatttgtgggttttcattatggtaattaacattttcttaggcctgatatatggaagcttaatttctttcaattaccaaactgcttgactctaaacggtggtggatattggggaaccaggagaggctaataagatcttaatgatcagaaatacaaaacatagtgtttttgcaaagtgaaatacttagtgttaagatatttaccatttgtcaaaatagatgtgtagaataataactgcagcacttagcgatatgccaagctctgagctcatgcttaagtgttttatcccatttaatatcagcaaaaagcaggtattattatccgtatttctgaggcatgtgtccagggtcactcctgtgtgaggtttttttcaccaaatgtttctctttaagcatttaaaagaaggtactctaagtaaagtgataagagttacaacttcatgttaagagttataactaatacacgtacattttcagtccactctttttagttcctaagtctgacagagtagtattggaccatatgttcggaggagcaaaaactgaagtagaaattcttgtcttccatattagtaataattgtgtatacagaaaacctattgttaggatttagtaggacttccttaaatgtttgctaaagtgagtgggaggaagtgattgaaactgtaaacataaaataacatgatgttggggatgggagaaagatgaaaaagtattgggtttacttccaggttatttttctgtcagtgttgcgcaagcatttctctcaccattgccacttgatagtcataacctacaacttgccaaagacatctctgcagtatgtgagtagacggcaccttctgataatacctgaacgttttcctttttcgagtaacttgttgtattgttaatatttgcagagaaatgagagaggtgatgatacctgttacttaattaagttgtgaaacaaatcctccttttctgtatcatacatgatgggttgaatttgactgttacaataaagcataaacaaaatgcctcctgtaagtaggaaataagactggtagtcattgtcactttcagcagcactaacttttatcagtcttgccatctttgggaaatgaatagaaggtgaatagctgagcactcagcatagttcagcagtcattttggcatagcagtttacatgttatgctgtgctttaaaaagagacttgtgaaaacaaactctccgttcttgtgttgatctttgttttacaagcattagtgttttcgatccatgggttgggaagataccctggagaaggatatggcaacccactccagtattcttgactggaaaatcccatggacagaggggcctagtgggctatacagttcatggaccaccaccagtattcttgcctgaaaacttctaagaggagcctagcaggctatagtccatggggtcacaaagcggctgagcaactgagcacatgactgcacgttaactacgtaaagcattttagtgtcatagactcaaagaaacctccctcttcactggattttctgggtcattgaccccatttttttcctaatagaaagtcaaagtaagacttagagtaaaaaatttctaagagtacacctgaaataagtttcagttggctcagctagttcatttctttatctcattaggacatagtacattgtgtttctcaagcattttgagtggtaaaacagctgctaatcaaggctgtgcggaaggacgttttgatatactttttccaaaatgtggtatattagtctccttatgtgacatatttggacctcaacctgtattaggtaggtgtgtgtacataactgtatgatgtatctttaggactgcttgccatggattgttgctgggacttcacattgagtttctcctgggtagactgtcaaacagtatgacattggaagattgtgaatttcattttgctccaagcaccacaggaaacagctgaaaatagaatatgccgtcttctgtgttgctttatttacagtctgatttttattgcctcatcaggtacccaaggagttgcaccaggtcccgtcattgggctccaggccccgtccactggtctcctcggtgcccgacctggcctgatcccactccagcgcccgccaggaatgcctccacctcacttacagcggtttcccttgatgccacctcggcccatgcctccacacatgatgcaccgaggcccaccaccaggcccggggggcttcggaatgcctccgcctcatggaatgaaaggcccattcccaccccacggccccttcgtcaggcctggcgggatgccagggctcgggggcccggggccgggcccggggggtcctgaggaccgagacggaaggcagccgccgccacagcagcaacagcagcaacagcagcagccacctgcacagccgccaccgcagcagccgccgccagcccagcagccgccgccggctcagcagcagccacagccgttcagaaatgacagcaggcagcagcagttcaattcaggtagagaccaagaaaggtttggaagaagatcctttggaaatagggtggagaatgaccgggaacggtacgggaaccgtaacgatgatcgagagaatagtaaccgtgagaggagagagtggggaaggaggagccccgaccgggacaggcacagagacttggaagacaggaatagacgttctagtgggcatcgagacagagagagagattctagagatagagagtctcgtagagagaaggaagaaaaccgaggcaaagagaagcccgaggtggcagacagggcaggcagtaacaagaccgtggaacctcccattagccaagcgggaaacgtagacactgtttcagaacttcctaagggggagcctgggcctgcagtcgcaaagccttctgaagagttacctgctgaggctacctcatccgtcaaccccgagaaggaccccggctcagcagcagaggctcctcgttaagagagactgggatctgtcggatatgacagcaacacaggagggtagggcttggggtgtacagatgctgtattatacctgctcctgctatgtcacagccccgcagtagttggtgggagctgtaagcaatttgattgcttcccttctatttaaaaatagtcacaaaataacaacaaaaaaaatactgaaaatatgaataaatattaccctttttgctgtaactttttaaaagttttgactttaaaaagtttacaaatcgtaattagaagtgctctctattttttttttttttttaatttaagacaaggtaacggtgaaagctcctcaaaaaacaatagggatgtttttaataaactctattttcgtaacaaacttttaacgtgtgctattcttcctacactgcattaaggtagaaaaggactgttcatcaaagtttgagcggttaatgctgtattagtctaaattagacttgttgatttgatggaaacagacatctttatgtagttattttcaaacacttgatctgtaatatttttgatttttagcatttcaatcctaaggcaaaagttagtggttttaatgttaactgaaaagcttgagttttgggattcaatcaaggtgttctcctccccacccgccacccattggctttgtggtaaatgttgccctaaataattggtaaaaaaaattctttgctaagggaacattggaccccaacattgccaattgtactataaattattgcctgggtattacttctttagaaggctggttgtctttcttaccatcccattaaatttttcaaaaaggtgaaagaaaatcaaggttagtgtctgcagctttattagctttttgtctcatctgtttaagaacttaaatgcagcccccactgtttctgtaacccttgcctgttgcctctcttttcccctactgagcagaggtaaactgagcttttcacccctgcaaagtactcgctcttctttaaaataattgggttaactaggaagaacagttgtgagttatccaagaactgttacatgaagatatttaaagggaaaacctgtacctgaagtagtacagagaagcggttacataaagctgctgagctagtgccaaggaaaagaccaaccattaacacaacccaagtatttatggccttgaagctcttttctccttaaactatgtgtctaaactgtcctagtttgtgtgctggtacagcttcttcaccctcatcccgaggccaagctgctttatttggttttgattttctgcagcaagatccttaatgggtggtggggggaaatgtacccgggcaacgtttggaaaataagagaaaatcccgtttcacatatgtagacctgagtcataagcttaccctggtgtatgttggcccactgagtgtcaaaaggcctagctgaaactgcttctggaaatacacatctgattagtgttcgggtttcaaggaaacagtccagtatttccaattgaaagtattaaggtcaccctatttgctcatgacaaaaccccagaagtattaagtgggagtaattacatttgaggccttaaagacccaagcaagtccatttatgtaacaaactaccttatgaaatgttagtgttggtttttaaattccaatgttaatttgtgagcatactgttatcaccaacttaaaactgaatacactacatttatttttctaaattagcttttcctctccaagtgatcttcactggctaaagtccaaccaaaacagttgcttatttctggcttctctgtcaaatatcctataaatttcaatgaataaactataacccacagtcaaacctgtgttaagatcaacacttcattttaaagcattcttctataggcatacgtgtttagagaaacagacttgaattactaattgggtgtagaaattcttgtatttaaacaggcagaactcacaactaagtcatttctttgcttccaccttacagtgggtataatgtatttctttaaagggcatatctgaaagcaggttgtgccaaactctactgttattaaaaataagtggccatgggtctataaaaatggagtatgtgccattttgacaggtaggtaaattaatcttactctgctaaggctgtaacttgccatttacaatttcactaagttatcaaagggctctcttaaattgtaaacagctactttttaaaataaagttaccaccttaacttccctaaagctaacaaagaatggcctatttgtctgagattaaagttcagcttagtcttagctaaatttaccaatcgctaaaattttaacatttgaatgatctcatttaaaaacactttcaaaaaaaagttctataagatagttaatacccgtcaacatattactaagagatttagtaataattcacactctatgtatgaatatcaagttaatttagaatttcaatttaaatacttcaacaggctcaaaatacagtgccacagagaatgtttattgcaggcttgagagaatcgaagaaattcagacaaataatatacatgtgattaagtctggcaaaatacagagatgaatgaaacacattttaattgcatatgagttttataaaattatacaaatctttcaagtgatcataagtcagttctcattacaggtacttaaagcaatttttaaaaagtcacacatattacactttttaagtttacagtgttaaatgcttatcaaattaaatttctacaactagcaagataacagatgagttactaggactaagaccatgtcccaaggaatgtttacttggcaattccaattacaccacaggccaaacgacttccagcgtttccagtctttgtactttcttcatttccacctctgcccaagtcatctggtttttcatggacctttaaaaagttttaacaacaaattaactcaggctatcaagcaattaccatctcaacaatacccaaaagacttttaagaaccactgaatattagaaaataccatgttaaaataatcctactagtaggaaaatacataaatattgagtagtaaaaagtagaaactaccattcagagctttttcttgatgatgcagacatcataaagggttagcagtactatctcaaaaagacgagaaacccatagaattaggttacaaagtatccacatgctaaatctaccataagaaattttagtaatatcagagtagacattctttcatagtacaaactggtttgaggggaaaggtgaaccaaaaaaaactataaacttacaaaaactttgtctaattagctacagacccataaataagagataaacctaaaaatatcttgaatattcaaatcagaatactggagtgggttgccatgcccttctccagaggatcttccagaccctggaatcaaacccgggtctcctgcattgcaggcagattctttaccaactgaagctatgagggaggccctaaaaatatcttgaatattcaagcagtagccttttaaattttgctcataaaacattaagccaccacttggtggctcagatggtaaagaatctgcctgcaatgcaggacacttgggttcgatccctgggttgggaggatcccctggaggagggcatggcagtccaacccagtattcttgcccggagaatgccatagacagagcctggcgtgctgcaagtccagcagtggcacagagtcggacacagctgagtgactaagcacagcacatcaaacattgataagtgacttttctgcttcataactacagaaggaaattaattctaaggataaaagggtgaactgataggaagcgtctactgaaagttagctgtcctctgggagccttcaggaggcattccgtaggaaccagatgcagggctacatagcctggggcaacggcctcccacacgttacgcaagtgacaacaacctgcagacgtgaatgaatactggcaccaggtccaccccagactttagatttcaaatgctctggttaactgcaagggggaaacccagtagtgacagaaagcctggccatctgaagaccaaagacagcttctgtttccactggagaaggcggtggcaccccactccagtgctcttgcctgggaaatcccatggacggaggagcctggtggactgcagtccatgggatcacaaagagacacgactgagcgacttcactttcactttccactttcatgccctggagaagaaaatggcaacccactcgtgttcttgcctcaagaatcccagggttgatcaaaggtaatctgctttattactgcatcttagcaaaactggtcttaaccgaccttgaccattaattcaccttcactgttaagtgtccaacaaaataattgcttttcctaatctgaacggaacgtacaatttatatggaagcttagaagccaggattaacaattgtgaagtcatgacaacatacatgatcatatgttagaagaaatttcatgcatatccttattatatgaaaacttaccaccatcgtgcggccaatgatggaatattctcctgagagtgaaatcagaggatctacaatatccacgatggcaacaccgtttttgtcagctgtcacattgcccaggtctccaacatgcctaacatcgaaaaagcagagggattaggactgatttctgtctatctaactttagttcataagctaaattaaaaatggatgagtcagatatataagggtgacttgagagagcaatacggtattatcaaatagaatccacttttccatactgacaaaactttgaaaacatacaaattaaacaactaacaagatgttccagacacacagctcttcaagcaaggcttcaagtctataaagcaacactctggaaagacttggggtgcacccctaacctcagaggtaaagtaaacttaagagggtaaactctaagttactgagttatgcctattaatacttggcatggctaaaagagttatgcccctagccctttgatataaacgtaaattaatccttgtccttaaaatttaatattttcctgaaaggctttcagaaaacgaacacatacaaggggagtctcagtgaattttcaacattaaattttcatctacaaagttcccagagtttcacaatgatgttttaattttgctagtagttgacagtactgttattcatgacatttcctgtattagttccctttgacacttgtattagttctttattcaataaacgctacaaaacccaaatcgtttgcagtgtccccatttgtcaattccttagcccagggagtaatgccattccagtactcgggggcaaggcgttacgtggagcaacaaattcaaaagcagaagtgcaattatcttagcatacaatctgcaagtagtaaaccatactgaccacccctgcccaaagccagcactattatttcaaaaaagaattaaggtcactcacctctcttcatcttttggcccaccgtgttttttggacagaggattaaagtgaggacctgcactggtacagcctgttcacaaaagaaaaaaaaaaaggcagctaaattataaatcacaattccaaaataaattctaaaaacgaaactggtcattgctaaaagcctcaactggagaaaagtactgacccaaaatgtgacttctgggctagtaacaacagcaacagagggcagggagtagagacaaattctaactactgtgtgannnnnnnnnnnnnnnnnnnnnnnnnnnnnnnnnnnnnnnnnnnnnnnnnngcaacacgctgccagacagctgcggtctgggtcttggtcgcttttggaatataaagcagcatcctagtccaagggctgctgccctgcacgactctgggccttaaggttgtactctgtgaaaatggcactcctgagcaccggggaagagcatttccacaactatggaggcggctctttcaggacatgggtcttcactagatggctgtcaggtggggtgggggatggataaaggccgtgaacagcccccaccctccccactcagggagacgacacgcaggttacaggacgtggcagagtaagtcgaagccaaacagcagtcgcctcccaccggaggcgggaatgtttttcctttggctgcgccaggtctcagctgctgcacacgtgatctctagttgaggcacgcagggtccttaggcagcagcatgtggcctctgggttgtggcgtgcatgtggggactcctctccctgaccaggcatccaacccaggccccctgcattgggaactaggtggagtcttacccactggaccacctcttagtcccaggaatttttataattgttgaagtggatcacatctgacccttaaatcactatttaaaggaaccaaattatgggacattaaaaacaggttccagcaaaatgaattaagttctcatcacagaaggttgaaagactaagtttactcaaatacagcaacttaacccataaattttgttaacttgcttctgatcccaaatggagaaaatcaaactcaatccacagcaccaacacttcacaggccatcatcagtttgtctcttccttcccctccagccccgtcccaactaaggctcttgcgttggagctgtggagctgttcttccagggtaatgataaatgtaccccctgcctgtcacacccaccctcaacccccagctcacaaggaccaaaggccaagaaggtcagagagtagcagcaatgttttctattgttaaaaacacctgagactcttacataatcaaccaatagtaagataaaaacatcaattcccccttccattccatgagtcagtcatttttgtccctgaggctgatttgagtagtcctattgactttttaaaaaattgttggcaagtttttaatgtgtggggatggcttcctggatggctcagcagatagacaatccacctgcaatgcaggagacacagaagactgggttcaatccctgggtcgggaagatcccctggagaaggaaatggcaaccactctagtactcttgcctgaaaaatcccatggacagagagcctggagggctacagtccacgggttgcagaatcagacacaactgagcgtctaagcacacgagagcgcgcacacacacgcacacgcacatgcacacacacacacacacacacacactactaggtttatctcactaggtgaggtgactgtgaatcgctcgtcaccaggacaacacccaccttgtgtattgtctccaaactgatggacgtggaatccatgatcaccttcagtcaatcctgtaatggatccagttaccacgactgtatctccctttagtcaaaggaaagtgagagaagtttgaaaagagggcaaatgcttctgagcaaagaaaacgactgaattacctttaccactcacaggaaaagtgaaaagaacagcaactcgggagtcaaaagcctgtgtccaaggtttttggctagaaaggcccaccacgttctagcaatgaacccccaggtagctgcttaaccactcatgtgtaatacgagtaagttcttgcttattttgtaaatacttcaaataggttgtgctcgtgtgtggctaagtatatgtgcacgtatcaaacttgtgaacccaactgcttgcacgtcatacacttttcagcatcttcttcatgcagacactgctgtattatcaaacacacagattgtcttaaaaagaaaaaaaaaaggtttcctggaaatactcaacttgctatcccatggtccctcttctccactcctcccaggagagggacgtttatcagtttcccacatggatatttttggtttgtagccagagaatatcctcctcattgccactgggaagctgatcctagtctaaccagaagtactgctttctcgaggcttttcaggcattgaaacctagataacctttccactcctgagatcaaaaagggacaatgaaacaccgaagcaggtgaagaaaaacaaaacactgcaatcccagcaaaggtgatgggtaatggtactgcacgctacatagacaagtcaaagaagttacttccacagccacagagagatcttagcaactaaaataaacctaacacagcaaccacaccatataggaatagcagatggtgtttctgtttttttaaaaagacagggccgacagttacaagacgtgttaggccttgaagatctgattttccactggctaggtatcactgctcctggaaagtagcgtggcgactgctgcctcttgtatttctttttgaagacagatacactatgattcctctaggtaaagaaaaacccgaaatttaatagaacattctggaaaaagccaaatgtgaccgttatcccccaaacccgggcccccttagtttttacacctttcctgcgcagcttgtatggctccctcttctgggttctgaacctccattttggtggtgctctctgcaccatgttatcaagagcacagagaggcaaacacgcaggctcttccacacgcccactcaactggtaatgcacaggagaagttcaagggtaagcagcctggtacatcctgcgggaactgggctattctctcaaatgggtgaaacaggtcagggaagcaggaggaagggaaacgggccgcagtgtcactctaggctaacgaaggctcagcaggggccttctccagatgattttcaagacaagctagactctggacttaaaaggtgaaaatttccgatttttgaaaactggaaactaatccaaaaattttaaacactcaataagccaagaagtacaggtgatagtttactgacagtttaatacatctgcatacccaagggtcttttatcaggtgcagagagcaccaccaaagcggaggttcagaacccagaagagggagccatacaagctgcgcagggaaggcgtaaaaactaagggggcccgggttgcgtcaggttccacagtttggcttctgaatctaagtgacaccaggagctgcctctcagtggaggagggaaagaattcctcagaggcttcttaggttctctagtgagaggcaagaggagagacaagacagtctgacaaatgaaaagagcaaagtttagtctaatgtcaaaaagccttttcggaaaatttggaaaccaccaaaaggaaaaaattaagctcaaatatttaagttctccttgtataaatctcacataggacactttgcatatcctctcatgtttccataaaccactgtaaatctcattggtaccttaaatactccctcaagattaacaagccagcacaattttccacccactggcaacctaagatctgggacagtcttttcacaacatctgtgaaaagatgtttcacactcctcacaacatctgtgcttcacagtattatcactgtgtttctgtacactttgttttacatgattcgtgcagaggtttgtccaataccctctcagtaacaggcctaccggtaaagaaatttcaaagtcacatgactgaaaatgtttacaggaatactccaagcacagaaatgacaattccgtgcaaaggaaattactctagccctcctctccctggactcccgaacctcatcactgccctctatcaacagaattctcaatccgccatgaatcactttggaggctttaaaaacaccaaatttcagactgcaccgcaccaagttctgacgtaactgatccggagttgagccctggaatctctattttaaaaagctctgccagtgactctggggcttccctaacggctcagcgggtcgagaatctgcctgcaatgcagcagagctgggttcgatccctggactgggacgatcccctggaggagaaaacgtcaacacactccggttcctcttgcctagagaatcccatggacagaggatcctaacgggttacagtccatggggtcgcaaagagctggacacgactgaagcgacttagcacgcacgcggtgagtctgaatctgccgtgcaacccaggattaatatcgctgtctagaaaaccccccaaacaagggagtctgttagatctctgggtttttttggagctctgaccagggccgtcttctccgtccccacagagcctgaccatgacctagagcagggtgtgtcagcaaacttttttgtaaagggtcactgttgcatactagtgttttcctttaaacacaaacattaaaacaaaacaaaaataaaaatacaaagacctgaacagatagaaccactcagctcgagggctgtacaaacaccaaacccggcacagactgtgcgcgtggttcgcagatccctgagctggagcactggagctgcaaaggaagccccaaaaggataacggacgccacgagattcctgaaggcccggccgcaccccgccaaccccgagatctcaaggacgggccaggcctcgggactgcgcaactcaagaatccgcagcatgtcaggacccagacactgaccccgccaagaagggggtaggggggtggggaggggggtgaatagccacacggcctcctcaaagcagggcaggtctccgtcggggcctgcggacgtcgaaggggcgccgtggcatccggttctcctcctccctcgctttctctccgccctcccgggcccgtggttgtcggcctcaccgcccccacccccacacacacaaaggggccgaccgggtgttcccttcctgcaccccagcccaggcctcgcctcgcatcgcccccgggctcgcccggtgactcagcactttgcgggcgcgcggggcggcccgggggtgggagtggaccgcggatccgccgaaccgcgcgcgccgggggagggaggcgtggcgagggcggcccgaggcccggcggggccggcctcccgctcccgggcacaggttggcgctcacgcgctcgccgcttgtctcccctctagtcccccggcagcccttgcctttgcctcgaagtggatggtgccttgcaccgggccgtcgcccttcagcacgcagacggccttcgtcgccatgactcgggggaaaggctctccggcccggaccgctagagacgccccaaccaagtagagaaaacgacgccgcagaacacacgccgacgcaaaaccgagagaagcgcgccgccgcacttttatagggctggacggccgcgccccgcccaacctggccctcaaccaatcgccgcccgcgctctcagcgcgctcccccgcaacggggtggcctcgggggggccctgacggaggggcggagcctaggggcggtgtggggagcccgtcactcaagcgccgccggccctctccgccctggggctgtgtgaaaacgcgcagtaaaacctggatccgtgggggaaaaaaaaaacaacctccacccaggctttctcctcgaaagggtgtgatctgcggattgcagtacacgaaagtgggacagggaggtatatacgtggcacgcctggaagatatgaagtccctttgtccgcaaatgttaatgagtgataactgactttggtcctgacgttgtcgcttttgtgtttcacaagttgagacgctcatgctgggtgtttgtgataatttccttttttttttttaattgcgttgtggctttctgagggtctgtaaagacggtggatctccgtcccgggtctcaccttttcttctccgcaattcttagtcctaaacccataaaacttacgtatttggttgtcagaattacgtctttcgaatatttcctgtgtggcaaggccacaaacctgaaaatgcccccccccccccaaaaaaagccaactgattgatttctacatccctctgtgttttgtctgctgccccaacagtcaaggagagggggagaatgggtgaatgatacctccatacatttcttaaccttcaaggaaggcgtttcttctgtgggtttttattcaaaagtataaacatgtttacttgtgtgctcagatatctctagaaagatgtacaggagactgtgggtgggtacctttgggaaatgcaaatttaacttttactaatgttctctcaaaatattttttttttttacagtgactatgcatttgcttctctcctgactcagatggtaaaaaatctgcctgcaatgcaggagacctgggttcactccctgagtgagaaggatcccctggagaagggaagggctacccactccagtattcttctctggagaattccatggagagaagagcctggccaactgcagtccagtggggtccgcaaagagtcggacaggactgagtgactgacgctttcacttttacacttttcactgtgcatttgtctgcaacagtttggctcaggagaatccccaccaccgccaccatctggccccacccccacaaacatgcttttcttggcaaaatagtttgataaccacgggattgccagggggcatcaagagaagaatcttcctcttccctcctcagcgggctgcctgagtaacaaagatgagtgaactgttttcagagatgaggttaattcaatcaggaagcacgctttcgactcatctagaaggctcgttaaactgcagattgctgtgtttctgacccagtgggtctgcggtgggaacctggaatttaccttcctcccttgttcccagggagctttcatgttggcaggttgagaaattctgacctgcagctgtttttcatgcccagtgaagtaggcaagttgagggcaagagctggacctacttgactcaaaagaggagatggggaaagtatactgaaaagaaacagggagttaaggagacccagacaggggccgatgagggacacacctaagggaggagagatctggctgctagggatttctgttgaaatcctctgcttctcccagtgaactcccaacacaatctgcctttccgtctaatgtagggaggatttagttgtggcgctagtggtaaagcctgccagtgccggagatgtgagagacccaggtccaatgccctggtggtgaagatcccctggagaaggatatggcaacccactccagtattcttgcctggagaatcccatggaccgaggagactggtgggctacagtccatggggtagcaaagagtcggacacaaccgaagtgacgtaatacacacacacagttgtggggatggtgaaatgctgagtgagacctagttcaaggtcagagtgaaacaaggcagaaactacttcagccacgtcttggctgcacatgacttatttaattctacctttgggctcataccgtcatctatcacaggtacacagttcactttttttttatcatcctcttgaaagtatacatatttgtaattttgcttgttgtactcaactagcattttctagttagcctgtacgttgcataaatgtgcaaatcacagccaaaggtcctttgcccaaggccaaagtctctttggcttccaggaagttggaatcagatttcagttcacatgccaacaatctaccccatgtgcagtggtgctgggatccaggttcctcctcttttgagataggtagacaaagcctgggtcagtgccagggctgtgtcatgcagggttcgaggacccctgaggttcattcctagaactaccctcacacctaggcaaggggttccacactgcagagggccctgttctgttcctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaggtactaaggtaagtgaaccaaaactgaattcaattttggtttgaaaccaaatttggtttaaattcaaactctggtttgaatttaacttgactaaactccacaacaatacttttcacaaataataatgttcacattttacaaacaaaagaaattggatcccagagaaattgagaggagtccccaaggttatacaggtagtaaatggtgaagctggaaaactaagcaaacattttagcttcagagtctgcgcttttatcagaggatcaatgaaatgagaattaatctatgaaagcacatattagcaggcttatcacatagtaggcataaccaagtcttttctccttctcttaatccccactaaatacacacacacacaaacacacacacaatttttttccctttttggccttgagattacttacagtaaacaggagtcttctagagaataataacgaggtgaaaacttaaaaggcaatgagggaaatttcctttagcctgagcgtgcatgtgtgctaagtcccttcatcatatctctgtgtgactctatagactgtagcccaccaggcccctctgtccatgggattctctaggtgagaatatcggagtgcgttcctaagccctccccccaggggatctttccaacccagggatcaaacccccgtctcttatgtctcctgcattagcagctgggttctttaccacttcagttcagttcaattcagttgctcagtcgtgtccaactctttgcaaccaaaggaatcgcagcacatcaaccttcctgtccatcaccaactgccagagttcactcaactcatgtccattgagttggtgatgccatccagccatctcatcctctgtcatccccttctcctcctgccccaaatccctcccagaatcagagacttttccaatgagtcaactcttcgcatgaggttgccaaagtactggagtttcagctttagcatcattccttccaatgaacacccaggactgatctcctttaggatggactggttggatctccttgccgtccaagggactcactctcaagagtcttctccaacaccacagttcaaaagcatcaattcttcggcactcagggttcttcacagtccaactctcacatccatacatgaccactggaaaaaccatagccttgactagatgaaccgttcttggcaaagtaatgtctctgcttttcaatatgctatctaggttggtcataactttccttccaaggagtaagcgtcttttaatttcatggctgcagtcaccatctgcagtgattttggagcccaaaaagataagtctgacactacttccactctttccccatctatttctcacgaagtgatgggaccatatgccatgatcttagttttctaaatgttgagctttaggccaactttttcactctcctcttccactttcatcaagaggctttttagttcctcttcactttctgccataagggtggtgtcatctgcatatctgacattattaatatttctcccagcaatctggactccagcttgtgcttcttccagtccagcatttctcatgatgtactctgcatataagttaaataagcagcgtgacaatatacagccttgacgaactccttttcctatttggaaccagtctgttgttctatgtccagttctaactgttgcttcctgacctgtatataggttttctcaagaggcaggtcaggtggtctggtattcccatctctttcagaattttccacagtttattgtgatccacacagtcaaaggctttggcatagtcaataaagcagaaatagatgtttttctggaactctcttgctttttccatgatccagcggatgttggcaatttgatctctggttcctctaccttttctaaaaccagcttgaacatcaggaagttcatggttcacatattgctgaagcctggcttggagaattttgaacattactttactagcatgtgagatgagtgtaattgtgtggtagtttgagcattctttggcaggcctattcatttcaaccttgagattccacgattctgtggctttggggtgctcctgccccctaatctagtcccaaaggtcatgtgtgtgatcagagaactcaggtggttttgaaaagttcaaatcccattgagagtcattatctccaggaagttgagggaatccaaaaggaggttgggttgtcttgagcccaggaatgtggctggcctctgacagtcaggatgaggcacgttgacccagagagacttgagttttgtagggaatggagaggactgggggccttggaacagattgcctcatgtgcagatgactcagcagtttaccgtgtgtccttctggtgttcctgagcatgaaaatcaatgtttggttaagaagtaagtgagaaggtagaccagctgttcagtcttgcatttccacccctttcctcttcttttcctttcttagggttcatttctcccttttctcccttatttcaggcttccccagtggctccaacaataaacaatctgcctgcaatgcgggagacctgcgttcgatctatgggttgggaagatcccctggaggagagcatggcagcccactccagtattcttgcctggaaaatcccatggacagaggagcctggcgggctgcagtccatgggttgcaaagagtcagacacaactgagccactaagcacagcacagcactcctttatttcatctcccttttttcccaaaatcattttttttctcctgaaatcccaaggcagatcctcctttacaccttcatggtgcttaataaataagtagttttcttttcatctgcttcacatcacacatcgcaaagggattatcaccaaaacttttgctgatgaaaaatatgtttttgtatatgtgcttagttgctcatttgtgtctggctctttgtgaccccatagacccaggagatttttgaaaacagtgtgcttgggcccgattacattcacatctttaaattgtgtttatttaaatggtagatgcatttgacattgctgtaagttacataagaaactggtaatggccttcattggaaatgggctgcttaccttggcactttgtatcctacgaataaataaaacttatatttggttaaacaagcataaccaggcttctgttacatgcagttcaaagtaagttccaactgaaagagagaagaagccaccaggggagttttatcaggaagggacttgattaggtacatgagtaagatggatcctagatactcatgtgggtagatcagaagagagtaaagtgaaactgagggcagaaaggctatttgggagtagtgatataaggtcctggtcggaggccattgctagaaaacagagcagagagaatgaaaaaggaaccttcagcctcaggacctgaccaaacctgcagcgtgagggtgaagcagggcaaagggtagctcccagatgtggggattgggtgccagagtggaggatagagctgccacttattgataccatgaaaagaaaggtccagattcagaccttcattcaggacaagggtgcatctgggtgcctgaggaagctggaagtgctgaggtggatgcatccttttgaacacagatgtgaacctcagggtggccctacgtggcatggctcatagtttcattgagctagacaaggctgtggtccatgtaattagattggttagttttctgtcattgtggttttcagtctgtctacttggagaaggcaatggcaccccactccagtactcttgcctggagaatcccatggacggaggagcctggtaggctgcagtccatggggttgcgaagagccggacatgactgagtgacttcacttttacttttcactttcgtgcattggagaaggaaatggcaacccactccactgttcttgcctggagaatctcagggacaggggagcctggtggggtgctgtctaaggggtcgcatagagttgaacacaactgaagcgacttagcagcagcagccctctgatggagaaggataagaggcttatggaagcttcctgatgggagagactcactgagggggaaactgggtcttgttctgatggtcggggccatgctcagtaaatctttaatccaattttctgttgggttgagctgtgttccctccctgctatttacctggggccaaactatggtggaagtaatgaagataatggtgacctccctctaaagatcccatgcatgtactgccacactcagtgctcccaaccttgcagcaggccaccaccaacccacgcctctgctggagactcccatacacagaggcaagtccaggacagtctcctgtggggtcactgctcctttctccttggaccaggtgcacaaggttctgcttgtgccctcccagagtccgtttcccagtcctatgtagttctggctgctctgtggtgtggttaatggtgaccccctccgagaggacttatgccatacccaagtctgctgcacccagagcccctgcccctgcggcagaccaccgccgaccggcacctccacaggagacgctcacacacagttctgtctgtctctgtggggtccctgggtcctggtgcacacaaggtttgtttgagcactctgagcgtctcttgcgggaatgggatttgattctaaacacgaattcaccccttctaccatcttgctggggcttctcctttgcccttggatgtggggaatctcctcacagccgttccagtgcccacggtcctaccggatcaccaactcaatggacatgagtttgagtaaactccgggagttggtgatggacagggaagcctggtgggctgcagtccatggggtcacaaagagttggacacgactgagtgactgcactgcactgaactgtgaaccttggggtcacccaaagtgtgggctctgtatcagacccagtacacatgctattcagatttgtattgaaaatgtagttacctactccctttgtgtgtgtgcacactcagtcatgtctgactctttgcaacctcatggactatagcccaccaggctcctctgtccatggaattctccagacaagaatactggagtgggttgccatttcctcctccaggggttcttcctgacccagggattgaactcgtgtctttcgcatctctgcattagcaggcggattctttactagcaaagccattggggaagcccatttattccctttaggggatataattgtcgtcatgattctctaccacactgggtaggaaactggtggctcagtggtaaagaatcctcctaccaatgcaggagactcaggttcagttcctgagtagggaagatctcctggagaaggaaatggcaacccactccagtattcttgcctggagaatcctatggacagagaagcctattcagctacagcccatgggggtcacaaagagttggacaggaccgagcacacacacacacatacacacacaggaaccactgacattttctcaagttcatctggttaaaacattctttagagcagtgattctcaaatgttaatatcctgggttgtttttttttctttggccgtgccacatggcatgtgggatcttagttccacaaccagagatgaacttgtgccctctgcattggaagcatggtgtcttaacgactatactgccatggaagtccctcagatgttactatactttagagctggctagaaggcttgttaaaattcagattgctggtccacccacagaggtttgttgggtttttttttttttaacttaaaaaaaaatagccttattactatataattcatgtactataaaaaattcacccattgtaagtatacacttcagcagtatttttagtaaatttttgtaattagcaacccttcccaaaatgcagttttagaacatttccatcagcccagcaagtttcatcatgctggtttttgcttaagcccttctcccactccaagccctaggcaactacgaatctgctttttaccctgtaaatttgcttttctgaacatttctaataaatggaaacagtatgtagtcttttgcatctggcttatcagcataatgtttcagagcttaatctttgttggtagtttgttcctttttatgtctaaagagtattccatggcatggaaacaccataagttgttttccagtcacaaatttgtggacatttggatttattatgtgttgttgaattgtgaacctccaaaatacatatgttgaagtcctaacccccatgaaatgtcacctagtttggaaataggatttttgaaattaaattagttaatataagatcataatggagtagggtggaccccttacccaatacgattagtgaccttataaaaaggaaatttggacacgggcagagagaacaccatgtgaagatgaagacagagatcaggaggatgctgctgctgctgctaagtcgcttcagtcatgtccaactctgtgcgaccccatagacggcagcccaccaggctacaaagccaaggaaaacccagcattgccagaagctagaggagggacatgggacaagttctctctcaaagcccagaaggaacccatcctgctgacaccttcatctcagacttcaggtccccagaactgtgagccaatcaatttctgttatttaagctactttgttacagaagccctagcaaaccaatacaagattatttccgagttttgaatgttataaataatgctgctgagaatattggtatacacatctttgtggacatacaatttcatttctttttgatttgctttttaactttggttcaaaataagtgctagacaatatttcagtgggctacatcagcgacgcaaagatttcactttctccacatccttgccaactcttgctattatttttttttttaattacagccattccagtgagtatgtagtatcttattgtggttttaatctgcatctccctaacagctaatgatgctgagcatctattcatgtgcttattagctgtttatcttctttgatgaattgtctctgtgggtcttttcccatttttggccttataacactgtttggaagctccagcacagtgttgtagaagtggtaataggtggagatctttgggttgttctccatagctgggggaagaattcagtctcttacacttaagtgtgatattagttgtaggtttttcatagacgccctttatccaggttgaggaagtgaagtgaagttgctcagtcgtgtccgactcctagcgaccccatggactgtagcctaccaggctcctccgtccatgggattttccaggcaagagtactggagtgggttcccatctatttctagttagttgacatgaagggtgttagcttttgtcagatggtgtttctgcatctgctaacacgatcatgtggtctttgtcctttgttttatatatctagtgtattacgttgagtttcagatgtttaattgaccgtgtattcctgtaataaattccatttgaatggagtgtataatcctttgtatatgttgatgaacttgatttgttaatatctataatgttattttcttgtgctgtctttatttgatatcaggataatactggtgtcattgaatgagttgacaaatcatctcgatttaggcttttctttgtgggaagattattaattactaattcaggttcttattaggattcacatcagattttctatttcttcttgattcagttttggtcatttatgtcttctaaggaatttgtccacttcatctaagttgtgtagtttgttaatacagagttgttcatgaaattttcttataaattttaaatttctatagggttagtaatagtgtcccctctttcattactgattttggctatttgtctctctaattttctttttcagtctaactaagcagttgtcaattttgttaactcattttgaaggaactggcttctgtctttgttttgtttcttggctgtgtcacagggcttacaggatcttagttcccccggcaggaatcaaaccccaggtggggtcctaacccctggactgccaaggaattcccccaaagtaccgactttcggtttcattgattttctctactgtttgtctgttttctgtctcactgatttccaatctaatctttattatgtctgtccttctgcttaccttgggtttattttgcttttcttttgtctagtttcttaaggtgaaagcattgtttattgatttgagatctttgttcttttctagtgtggttatgtaaaactataaatttccctctaagccttgcattagctacgcctataacatgagatgtcacatttttattttcatttaatttgaaatattctctaattgctctcatgacttcttttttcacccaggcattactttatagtgcttgccttccaaatattagggttccccaaatttccttctgttattgcatcctagtttaattccacagtaaattgaaagaatacactttgtatgatttcattcctttcaaatatatcgagatttattttatgatctaatacgatctattctggggaatattctatctgctattgaaatgaatgtgtattctgcagttgtttggtgaaacattctacatatatcactaagtttcattggttgatagtgtttcttaagttctctgtacctttgctgattttctgtctggtttttctataagtaattgagagtgggatattgaaatctccaagtactattgctgtattgtctacatttccttttataaatgatagaagtatagttgatttacagtgttctgttagtttctgatgtatggcaaagtgattcagattcatttctttcatagtttattacaaaatattaaatgcagttccttgtgctgtacagtatgaccttgttgttttatctgttttatgtatagcatttcatatctgctaatcccaaagtcctattttatccctgcccccaaacccttgccctttcgccctttcctctttggtaactgtaagtttttttcctatggctgtgaatctgtgtctgttttataaataggttcatttgtatcatgttttagattctatatataagctgtatcatatgatatttgtctttgtctgacttacttcacttagtatgataatctctagatccacccatgttgctgcggatggcattatttcagtttttcatggctgagtaatatttcattgtgtgtataaggtccgtctagtcaaggctatagtttgtccagtggtcatgtatggatgtgagagttggactataaagaaagctgagcacggaagaattgatgcttttgaactgtggtgttgcagaagactcttgagagtcccttggactgcaaggagatccaaccagtccatcctaaaggagatcagtcctgggtgttcactggaaggactgatgttgaagctgaaaccccaatactttggccacctcatgtgaagagctgattcatttgaaaagaccctgatgctgggaaaaattgaaggcgagaggagaaggggatgacagaggatgagatggttggatggcatcaccaactcaatggacatgggtttgggtgaactctgggagttggtgatggacagggaggcctggcgtgctgcggttcatggggtcacaaagagtcggacacgactgagcgactgaactgaactgatacacacacacacatacacacatcacatctttaccattcatctgtcaatgagcatttaggttgcttccatgtcttaggtattgcaaatagtgctgccgtgaacattgaggtgcatttatctttttcaaattggcgttttctctggatataggcccaggagcgggattgttggatcatacagtaactctatttttggttttttaaggaacctccatgcttttctccacagtggctgcagcattttacgttcccaccaacagtgcaggagggttcccttttcttcacaacctcaccacatttattattcgtgtctacgtttccttttaattctgtccctttcgtttcatgtctctgaggctctgcgagtagatgcatatacatttataattgttatgctttcctgttatagtgactcttttatcattttagaacatctctccttgtctatgggaatttttttgctttaacatctattttagctgctatccatatagctacttcaactctcttatggtactgttttcatggcatatctttttcagtctttttagtttcagtgtatttatgtctcagaatctaaggtgttctcttgcagacagcacataactgactcttgcttttgtcttgtctttttgtatatccctgctctttgattggattgtagaccattcacatttaatttaattaatatctgtttggatttacaattgccatttgtttcctctgtgtctcctattttctttgtttctctgtccttcttgtactgctttcttttatgttaaaaaatttttagtatagcatttaaattcctctgttaatttttttttactattttaaaatttattttattagtggttactctgtagactgcaacatcttaacttaccaaaatccagttgtgattaatactgatccaaaatcactgcagatggtgaatgcagccatgaaattaaaagacacttactccttggaaggaaagttatgaccaacctagatagcatattcaaaagcagagatgttactttgccaacaaagttctgcctagttaagccaatggtttttccagtggtcatgtatggatgtgagagttggactataaaaaaagctgagccccaaagaattgatgcttttgaactgtggtgctggagaagactcttgtgagtcccttggactacatggagatccaaccagtctatcctaaaggaaatcagttctgggtgttcattggaagcactgatgctgaggctgaaactccagtactttggccacctcatgcgaagagttgactcattggaaaagactctgatgttaggagggattgggggcaggagaaggggacaacagaggatgagatggctggatggcatcaccaactcgatggacatgagtttgagtgaactccgggagttggtgatggacagagaagcctggcatcctgcaattcatggggtcgcaaagagtcggacatgactgagtgactgaaccgaaccgaattctagtaaaatacagaaactttgctccagggtagctccattctctcccctctcctttgtattattgcagttatatataatatacatttatatatggtataaacccagcaatatagtgtgacaattattgctttatacaattttatgtcttttaaagacatcaggagaagaaatgaggaaaatatagagccttttatatttacccacacatttaccatcttcaggacttttcatttcttcctgtgcgttcaaattgtgatctgatgtcactaactttcaatctgaaggggtttctgtagtatttttttgaaaggaaaggctgtcatcccttctattaacagtgcctctggaggtgggcattacccactacaccaaatcaattgagtccccttcaataacagcaccgtgtcggtccccatggcctggccagcactggcagggcctccacacccagtgggctggaggagatggaagcagtcctcacaggcacgcctcaggtatccactagccttacccaaagttcagcagttttcaaacataaacacgcctcagactattatacctgtttgttcaccttcgagagcccttaatgttgttgatgtcaattttatctagctttatagttgcttcctggggaaaggatttgctaaccatttcacttggccctacccagaagtctgtttccttcccgctatgtttctgattcattaaccctgaggtgtagctgggaattttaaattttaatgagttctcaggtaatactaatgctgctggcccagggcccacactttgaaacctactgctttagattaaatcaatctcttttcgatgtgaaaacaactttctcaagtatgaattcattatgagcacacatgaaattttattttaaacttgctgcaggggaacaaggcatccaataaaaccaatccagatatttctgttttatagaaactttcagttgcaggaaaggtgactagataatgctgttaacattaggttcaagaaaggcttgtctgttcagcacaagcctgctggtctggtcagcaatttcggtgattcataacaagaccgttcaagtaaatctaacagcccatgagggctcttaatctcatcaaagtctgtaagaaaattgctgttattttatcatgaatgccagacactttccccgggaggctgttgattatcccaagcccctccggtcttctccaggctgccttgctcagatggtggaagtgctctctcacctgagcaaatccagtttccccgctttcctgctgttgtgccctaggaggcatgccgggcatctagttggcagaggtcaggcagcagtagaggcgggcacttcctgtccacgtggtgtcatcagggtcctcgctggtttctgccgtacagcagcgggtccagtctggttctggaccagtgacagctgtagcatgactggccctccactgtcatcggtggttctgactattgccaacttgtcaccaagtcccaacttctttgcatttgccccagtcttctgctggtccaccggtcaattcagccttttcatatcccagcactggggtgcacaggaacatcaggggctctaggtaccaaacagaggctacattttactgctccaacttctctatcctgacaactctctctgcacccagtgcccaccctggcgccctgttgggatgcctccacgcggaacctctgcgcccactgcccgccctggcgccatgttgggatgcctccacgtggactctctgcgccccactgcccaccctggccatgttagaatgtctccacgaggaccctctgcacccactgcccgccctggccacgttgggatgccttcacacagaccctctgcacccactgcccgccctggcaccatgttggaatgtctccacatggaccctctcctaaagctttattcctcctccacccactgtgatatgaatgccgctagctttcataaagttctcaggatcttccatttcgtctaagtgtttctacctcagcagtcacagggagagaggaagtgaggacccgagtggcccatgccgcttgcttcgcctatggccctctctcctttccgtctcttcccatcacgtgaaggacagcatgttttactttctccacctcagaggatctctgacgtgagctacatcagaatcccttgaagggcttgtgaaagcactgatgactcaaccccatccccagcgcttctgattcagcagctctgagatggggcctgagaaggtgcatgtcttttattttttaagatttcttatttatttatttggctgcaccggatcacggcatgtgggatctaattccccaactggggattgaacccaggtctcctgcattaggagcacggggtcttaaccactggacaaccagagaagtcgcaaaaatgtgcattttttcttaaatttcatgcatttattttattgatgattttttggctgtcctgggtctttgctgctgcaagggcatttctctagttgtagtgaaggggggctgctcttcactgtggcacacaggcttctcctggcagtggcttctctcttgtggtgctcaggcatcggcagctgtggcatatgagctcagtagttgcagctcctgggctctagatcgagggctcagcagttgtggtgcatgggcttagttgcttccaggcacacgggatcttcccagattaggggtcgaacccgtgtctcctgcattagcaggtggattctctaccactgagccaccagggaagcccaagaatgtgcatttgttacaagcctcctggtgatgttgttgctgctggtcttctaaccacactgcaagaaccactggtctaccttctaccctgatttcttgttcccctcaatttaaagtgaaattctaagatcttttcagaagacttgatacgtgagttgttagtggatgctaaaggaacttaaaaaatcctttttctcaccaaaaatctttctattggcttataatgtgggggtgactataatttatttgtccaaacggggatacctttaatggttaggtgcattaatattaataacaataatgccaagatcacgagagtcattgggactgccctaggcaaaccaggatgcctgtttaccccatgctacagctcaagaaaatcgtctttggaacgcaaagccataacttccttgttctaggagtaaacggactctcctgggacaaagaggctggtggctcaaacttggagttggaacgctgccagggaatgtgatttaagagggaaacaaaaacataaaggtttaatatcttcaaaacatcatcccgattgcattcatttgagtttcccacctataacaccaaggtgacccagtggtaaagaatacacccacagtgcaggagacacaaaactcaggtttgatccctgggttgggaagagcccctggagaagggaatcgctatccactccggtactcttgccatggagaatcccatggacagaaaagcctggcaggctatacagtacatgggggtcacaaagagtcgaacgtgactgagctacgaaccacgcacctatagcaccagagagcctgattatccttcagccacgaaataaaagccgtttgcacttccttccaggcacaagcaccaccagctctgttgggcatcagccctcttctccgtcccccagtgtccttagctatttctgggcatgccccaagtagcagctcacaggtgcccacaaaccagaatgtcagttgcagccccccacgaggccttctccttcctcttctactctggcttcttgttcccctccgtggtccccagagccacctggagcagtttcgcttctgcagcttcccatcaaaagggcccccagttccacgccaggatgctgcctccagatgctccctcgtctcgggtaccagagtgtggcctctcaactccctgccgctctttgtgtcctggggcccagggtggatgagttttgaaggcaaggccagtaggagttgcttgatggttggaatactgggtgcaagaggagagaagtcgaggatgattccagggtttcaattcactgtgtgagattgttgttatttaggatggttgggaagactggaagactatgggtggagcaggttttctttgtgaggaaaaggaaagatcagtagtttcattttggtcatagtaaagtctgtgatgtcacttggatatctaagataagaaagggaacaatggaccttccctttcaacttctacacagagttgaaccgaactataaagattattttccaattccagcaggcactgttgcctgcctgcctgacggccctgttttcttttctccgtgcagactggcagagtgtagattttgctccagtgtctgacgtcagctgtgtgactggaggaaacagtctaaaccagccaggtcaccccattctacatgtcactgagaagtagagccataagtctgacactcagttctggtcagtgagacatggtggggagcggggaagtcatttagggactctggggagtgtttgctttctttaaaaaagattcactggtagacaggatatgataaggctgttggcacagataccctcacagtgtgaagtgctgtgaagttgaagttgaaaggcaaagtccattgttacctttcttatcttagatatccacaagacaacacgaacttaactatgaccaggacttccccggtggtccagtggttaagagtctgccttgcaatgcaggggatgcaggttcaattcctggtcagggaactaagatggaacatggagctaacagtgtcgtgctgcagcgcgactaacccaattgccacagttacagaacctacacactcccaagcccgcatgctacacctagaaagtacgtgtgctgccacgaaagatcccacataacacaactaagacccgacacagccaaataaataaatacatattttttaaaaagaaatgactttattaaaaaaaaaaaaaagatacatgaaaagaatttggcttttcctcctgaatgtcctagggcagccatcctgcaaacatgatgtgggtaaaagcaagctaaggatggtcaacctgaaagatagcattttctagcccgttagttaactaactggaacccgtcccttctctggatctcttctgcaagataatgcactctgtgaccagttaagccattctgagaagcgttttcttcacttgcctgttaaagtatcctaactggcacacaaagccaggagagaaagtcagcctgcggagaacacctcacaaccttcagggcagtgatgaagatgcccaggtggtcactagcagtgtcaagccggaccatcccagtgcaaggcactgacttggttatgaacatgagcttgcagctgcttgttttgtgacaggtctgtacttttttctttgctagagagggctggcatttcacactgtgagggtatcggtgccaacagccttatcatctgtctacccagagctcctccctcctacacaaaaccgtccttggcacagagagtcaagtccgtgaattgctctcacacttcctgttccactttgcactcacaagcacatgttaggaggccaggcaagtatcatatccccaaattacagactgagaattaatactctgaggtgatcacagcctagaaatggcaaaacccggacgagcaccagggtccattccaggccagcagtcttggaagcaccccatgaaatttgttttaaagtctaaaatgatgtcttgtcgttgtcctcacttggttattctaattttgcaggtgaagcctgattaaagtgactaatcgctgtaagactctcacgtgtcttgattcagacaaaacacatactaagtacctaaggtctctaaggtctgtttggctttctattactcaaagtaatagtaattttccttcaaatgccacttgatcaggactgttttcccctttacagttttcttacaagcgtgttttgagtttacttttagtgctgtatgtaacaggactcataatcacagtaattccagagatgatcaggtatttaaattaatagaagtcctgctacatatgcaattagttgtgcatgaaccaacatggtatatatattctttttctcgtaaagctcttcatttgcatgggaataagaactctgaactggtttgaagtgagaaattcagtccaattttaccaggaagacaagtcacaccagttcacttggtgggagagtgcttcaatctggttttgttgggaactaggtattttaccaggaagacaaatttgtttgcgtaatagcagggaaattaacaatttaagacaagcacactatggcgaaccataggcaagttctgaaaaagtggttcttaataagttagtttgagagtgactggggaatgtccttattgtttacttttgttttggagataaaatgttccagaaatgttaacaagctggatttttcaaagagcaagtcttttttttttttttttttaatgttctaggaatgtttgatttgtcattaagagtggtggggaagcgggtagattttgccctgtttctcacatcaggtactcatccacccaccccttcctagctcttcacctccaagatgctgtaccccaaatgtctggatcagtgtcgtactcaggagcatttgacaatgagtgacttccagccccacctaaacagctagttagatatgtgaatccaatgcctttcttggggactggggactcatctcatccccaccatcactctctctggccagcaagccagagccctctggtccgagcatctagaacaggcctgagaagaaaggagagcttaccaggacctcccctccccccgacccaggccctaaaccaaaacttcccctatcagctctggggaagggaggtgctgacttacctgctcacccttttgggccatttgaatttaccatgctcatgtattttccaaaaatattttagtacatatatctttaaatgcttaactattaaaaataccactaagataaattttacacctctggctgaggctgtttaaaacaagataacaggcccccagtggaatcgtttgtgttaagccccatgttaccaagctgtaatttaattacagtttcagctctcccagaaatggaatctttaactagtcaatcaggaattgtcagattcctacactggttaaggtagcactggtgtgtgcagagggcctgtgcaataccctgcttttgctccagccaaagctatggtttttccagtagtcatgtgcagatgtgagagtgggaacataatgaaggctgagtgttgaagaactgatgctttcgaattgtgatactagagaagactcttgagagtcccttggactgccaggagatcaaaccagtcgatcataaaggaaatcagtcctgaatattcactagaaggactgatgctgaagctgaagtttcaatagtttggccacttggtgcgaagagccaactcattggaaaagaccctgatgctggggaagactgaaggcaggagaaggggatggcacaggatgagatggagagcatcactgactcgatggacatggatttgagctgtctcctggataggtggtccaggacagaggagcctggtgtgctgaagtctgtggggtcacaaagggtcagacccatattatcaatttgacttagcaactgaataacaacaacttaaaaagtggcagttggggttgttttttttttttttttttttgtctctttgtatcttttctccaaaattttccccaactgctcatgcaggcagttatttttatttttagtcccatacagtttctttgtattttgttgctagaggagaggtgtgtccaggtacaagcaccaccacaaagggtcccaggtcctagcctgtctcgctgcccccttgtttctgctccctctgcctttaggactctttcattttgtacggctcctcagagatgctctgtttcctagattggatgctgactgactcaaattactctttgctcaaataaactattaaaacagttaatatacctcagtttaacttttcacaagactgagtaaggctttcagttctcagagagtttttcctcccagaattgaaaagaatgggaagccatctcagagcggagcctttcttcaactttcaccttgcctcctttgctcatcagcaagcctccggtccagtctcgtgccaggacacaggttcagttcagctcagctcagtcgtgtccgactctttgcgaccccacgaaccacagcacaccaggcctcccagtctatcgccaactcccggagtccacccaaacccatgtccattgagtcagtgatgccttccaaccacctcatcctctgttgatcccttctcctcctgcccctaatctttcccaacatcaggggtttctccaatgggtcagctcttcacatgaggtggccaagtattggagtttcagcttcaacatcagtctttccaatgaacacccaggactgatctcctttagaatggaatggttggatcctcttgcagtccaagggactcgcaagagtcttctccagcactgcagttcaaaagcatcaattctttggcactgagctttctttatagtccaactctcacatccatacatgaccactggaaaaaccatagccttgaccagatggacctttcttggcaaagtaatgtctctgcttttcaatatgctatctaagttggtcataactttccttccaaggagcaagcatcttttatttattttttttaattttattttatttttaaacttcacataattgtattagttttgccaaatatcaaaatgaatccgccacaggtatacatgtgttccccatcctgaaccctcctccttcctccctccccataccatccctctgggtcgtcccagtgcactagccccaagcatccagtatcgtgcttcgaacctagactggcaactcgtttcttacatgatattttacatgtttcaatgtcattctcccaaatcttcccaccctctccctttcccacagagtccataagactgttctatacatcagtgtctcttttgctgtctcgtacaccgggttattgttaccatctttctaaattccatatatatgcgttagtatactgtattgatgtttttccttctggcttacttcactctgtataatacgctccagtttcatccacctcattagaactgattcaaatgtattctttttaatggctgagtaatactccattgtgtatatgtaccatagctttcttatccattcatcatggccgcagtcaccatctgcagtgattttggagcccagaaaaataaagtctgacactctttccactgtttccccatctatttcccatgaagtggtgggaccgaatgccatgatcttcgttttctgaatgttgagctttaagccaactttttttctctccactttcactttcatcaagaggcttttgagttcctcttcactttctgccataagggtggtgtcatctgcatatctgatgttattgatatttctcccagcaatcttgattccagcttgtgtttcttccagtccagcgtttctcatgatgtactctgcatataagttaaataagcagggtgacaatatacagccttgacgtactccttttcctatttggaaccagtctgttgttccgtgtccagttctaactgttgcttcctgacctgcatacaggtttctcaagaggtagatcaggtggtctggtattcccatctctttcagaactttccacagtttactgtgatccacacagtcaaaggctttggcatggtcaataaagcagaaatagatgtttttctggaactctcttgctttttccatgatccagaggatgttggcaatttgatctctggttcctctgccttttctaaaaccagcttgaacatcaggaagttcatggttcacatattgctgaagcctggcttggagaattttgagcattattctctacatgatcacatttcccaatcattaactcttatgtgcctgccaagttgcttcagtcgtgcctcactctttgtgaccctatgaactgtagcccaccaggctcctctgtcagtgggattctccaggcaagaatactggagtgggttgttatgatgtcctcctgtggatcttcccgacccagggaccgaacctgcatctcttatgtcttctgcattggcaggtgggttctttaccactagtgccacctggggagcccaattaactcttaagtcagcattttacttcagaagacaaagacacaggggcttgtacacgggttcagtatgataacataatgaaataaatattcggtcctcgtccatttccaacacagagatcctaaaatccttgctattttctaggcaactagagagataaagatgtccttttttaataattatttgtttaaaattttttatctgtctttggctgcactgggtcttcactgctgcacgaggctttctctcatcgccaggagtgggggctactctctagtcgcggtgcacgggcttttcactgcagtggtttctctagtgaagcacaggcccttggcgctttggctcagttgtggcacacgggcttagttgccctgcagcgtgtggaatctccctggaccaggcttcaaaaccatgtccctgcattggcaggcagatccttaactgctggaccaccagggaagtccaaggtgtctttttttatgttaatgagatgacttttggttccacctaaggatgggagtaaagtaatgctgaaaattctccaagccaggcttcagcaatacgtgaactgtgaacttcctgatgttcaagctggttttagaagaggcagaggaaccagaggtcaaattgccaacatccgctggatcatggaaaaagcaagagggttccagaaaaacatctatttctgctttattgaccatgccaaagcctttgactgtgtggatcacaataaactgtggacaattctgaaagagatgggaataccagaccacctgatctacctcttgagaaacctgtatgcaggtcaggaagcaacagttagaactggacacggaacaacagactggttccaaataggaaaaggagtacgtcaaggctgtatattgtcaccctgcttatttaacttatctgcagagtacattatgagaaacgctggactggaagaaacacaagctggaatcaaggttgccgggagaaatatgaataacctcagatatgcagatgacaccacccttatggcagaaagtgaagaggaactcaaaagcctcttgatgaaagtgaaagcggagagtgtaaaagtcggcttaaagctcaacattcagaaaacgaagatcatggcatttggtcccatcacttcatgggaaatagatggggaaacaatgtcagactttatttttctgggctccaaaatcactgcagatggtgactgcagccatgaaattaaaagacacttactccttggaaggaaagttatgtccaacctagatagcatattcgaaagcagagacattactttgccaacaaaggtttgtctagtcaaggctatggtttttcctgtggtcatgtatggatgtgagagttggactgtgaagaaagctcagtgccaaagaattgatgcttttgaactgcggtgctggagaagactcttgagagtcccttggactgcaagaggatccaaccattccattctaaaggagatcagtcctgggtgttcattggaaagactggtgttgaagctgaaagtccagtactttggccacctcatgcaaagggttgactcattggaaaagaccctgatgctgggagggattgggggcaggagaaggggatgacagaggatgaaatagctggatggcatcactgactcgatggacatgattctgagtgaactccgggagttggtgatggacagggaggcctggcgtgctgcgattcatggggtcgcaaagagtcggacacgactgagcgactgaactgaactgaactgaaggatgggagttggttgccaggagaaactgatcagaggttggcccctcagggagagggactgaagattgaatcagtcaccaatgatgatttaatcaatgatgcctatgtaatgaaccagagataggctgagacctgggactctctgctacagagtggcaatgattgcacctggaacaacttgcctcaagcaacaaacaaagaaattatatgagactaaaaataactgcgtgcgtgagcatacccatttggggcaaattctggacccaaaagatacaaagaaaccaaaaatcccactgccacttttgaggagcctattctgggagatagtgaagggcagggagggaagcctgctgtgctgcagtccctggggtcacaaacagtggcaaagagccggccggccagacccgacagagttaacaacaagagcgaaagcctggtgttggggggcaaagcagggcactgcacatgccccctgcactcagcaccacctaaggggtgggcagactgcgcaagccacccctctggcctgacccatagacacacccccaccctcaccccatataaggaacaagcctgctccccggccaaccccggctgctcccagtctgggagctagcaagcaagggagcctgtgctgtttccactcctcactgctgcagcagcagccccaatacgccttgccaaaatttcttgtctggcctctagtcagtttctattgactggggaagaccaagaactctgctcagtaacaaagcctccagaaaacctccaaaagataggatctggagagcttctgaactggtggacacgtgaaggtgggggagacaaggatgcctagaaaggaggctccacgtcccttccgcatgcctttcctcacacgtcgcgtccatctggctgttcatatccttttaggcgtgcgtgctaagttgcttcaggcgtgtccgactctgggcggacaccctgtgggctgtagcctgccaggctcctctgtccatggtattctccagacaaaaatattggggtgggttgccatgccctcctccaggggatcttaccaacccagggatcaaacccttgtctttcatgtctcctgcattggcaggcaggttttttaccactagcgccacctgggaagccctttccttttataatacactgatgatttagtgagttcagtgtttctctgagttctgtgagccaccctgaaagtgaaagtcgctcaagccttgtccgactctttgtgaccacatggactatacagtccatggaattctctaggccagaatactggagtgggtagcctttcccttctccaggggatcttcccaacccagggatcgaacccaggtctcccacattgcaggtggattctttaccagctgagcctcaagggaagcccaccctaagctactagggttagccaccctagtaaattaattaaacccaaggaagagggttgttggaatcaatctgcagctaataaactgaccttaagactgacttccctgatggctcagccagtaaggaacctgcctgccaatgcaggagacacagaagacttggttccgatccctgggtcaggacgagcccctggaggaggaaacagcaagccacttcagtattctcgcctggaaaattccatggatagaggagcctggtgggctacagtccatgggatcgcaaaagagttggatgtgacagcacaaatgcatgcgagatgccctgacgcttaaatctggagaaagatgggaagtatctgactggagtcatggagactcacggtgcttggagatcccctttagggtggccagaatggcccacccatattttgactgagtcacaatcacactgaagaaatagagaaagagacagccatgaaatggtgggtgaacatatcaggtgtctgcgatcaatctgtagaacttcaggtttggaagacggtagcagacctccatctgggaacactagctgaagccccaagccactaatatgaatgataggggacagttacctgatattctaaagagagatgtaaggatatcccctcataatttgctaagaggaggctggaccagtcttttgacctggaatgctcctgtaaacaatatgagagaaagtgaagaatctatcagccagatcagagtgagcatttctttgaagagcatggttggcttggggtgaaagggtgttttctacttccatgcccccccaaactcaaggcaaataacagggcttcaagagaagcctacctagcttcgaaaggatatatgtaccccaatatccattgcagcactgttaacaatagctcagacatggaagcaacctaaatatccattaacagatgactggataaagaagatatggtactatgaacaatggaatattattcagccattaaaaagaatgaaataatgccatttgcagcagcatggatgggcctggagatgatcatactaagtgaaataaatcagagaaagataaatcatattattatatcacttatatgcagaatttttttaaaaaaatgatacaaatgaacatatttataaaatagaaacagactcacagagttagagaaggaatttatggttacaggggaagggagagaggggggttagatgggcagtttgagactgacaagtacacactgctgtatttaaaattaaatgcctttccatgaaaaaaagagagcgaggcctgactggagtgtggatgggctgccaggaagaaagaaaggctgaacatgaggttgagcttgaagacatttagagaatggttattggaaggcagagcctggggggtgttgtggattgaaggggagttctgggctgaaaaaggactttgcttttcactttcactgtctggcttaatgtgttctttatgaatatatgtttcttatcttctaaaaagccaatcgtacttacattcaatttgtttaaatgtcactctggcccctcatttaggagagaaagtctcagaatagtaagtcaatgcttctcaagcttcaacatgcataaaatcccctggagatctggttaacgatgtatgctctgatgcagtaaatctggggtgtggctgaaactctgcctttccaacaagctcccagtgcccagaatgctaatgcatggaccacactttgagtagcaaggggtaagtgacttgtgcaagcctccccaaccagggctagaattctgattgcctgccttcccagagaagatgggcttactcttgccttttactttcagtttatattaactgccaccattaatcagaacctcataggtggtggggaaccacctgcactgactgttaggcttgctctttccgtgttggtgtggggaaatggtttattttattattttttaactattattgttattattttggctgcaccatgcagcatgtgagatcttagttccctgactgtggatcgaacccgggccccctgcagtgtggagtcttagccactggacctccagggaagtctggaaatggtttattttaaagcaatcacagatgatcctgttaaatctcagacttcagtagagctatgcttcccttaagcagttacataagcagttatgcaaccgtagtccgagagcatgatgtttttcttttgccaagaaaagcgtgctagaaaagagcccttaaggtagtaaaggcatttcctcctttctgaggcctcggaacacccgagggagccttgtctatcccactgcgctgtctatcccctgggccacaagaacctttgctgtgtgtctttccccaccctctgggcccttggtgcctgactctgtgacaacagtccccacaggccatcacatctggccctcctgacctccatgggagggctcgttagaccccttttacagatgaggaaactgaggcttcaatgcatcaagtatttgcctgaaatcacacacctagaattcaaagctttgtccctctgactctggagtcctcattgtcaccagcccaccatgcttagcctgatgtgggtcaccacgagggttagttagccttggaggaacccctggagcagtcaacccaaggcctggttcttttcccagccttccccttctgtgataaggattgtgcgtgcgtgcgtgtgtgctcagtcgtgtctgactctgcgaccccatggactgtaccccgccaggcttctctgtccatgcgattctccaggcaagaatactggagtgggaaaaaggaccccagtcggatgtcatctaattacccttggaactttcaaaggtataatgtggggtcttatgcaaaattccaagctaccatgcaacatcttttaactgtaatgaggaggaggaattgttcccaaccttctttacatgttgtgctttttggttcagaaatgctgaatctttcaagaggtggtacaactttgagtccttggcttgactatacaactttgagcttcatggcatgtcagttttgccatatttaaaagagagttattctgtgtataacagctcacagttgcaagtaccacatgtgaacaatatggtaactttaaaaaatgtttgtgttgtatttgaagactgtttgccataaatctgaagtttgaacttaatgtatttcaatttggtatgctaaaaaaaagcactgaattagtttaacagccttttaaaaaaaaaaaaatcaatactgtaagtttagaatttaactgaaaatataaaacccaaatggtttctatatagtaaattgaactgtaaagataacttatgtgtgattctgaatacacagataaaatgtttttaattcttccttaaagaaaaaaaaaaaatactggagcgggttgccatttcccctactccatttcaacccagggatcaaactggcatctcctgtatctcttgcgttggcaggtggattctttaccactgcgccacctgggaagcacattgaagattgtagctttgttaattttcctgtggctgaacttaatttctactgtgaacactcataccacaaggtgtaaaagcaacatctcagccagttcagttcaaggcttacatagtccaatcaaggtttttttcctctcttccttcttagctttgcttgctcctcctttttttggtgtgtgtgtgtgtgtctttattgaatttgttacaatattgcttttgttttatgttttggttttttggccccgaggcatgtgggatcttagtttccctgagcagggatcaaacctacaaccctttcattggaaggtgaagtcttaaccactggactgccagggaagtcccctggtgtgtgtgtgtgcttttaattgatttatttggctgcactgggtctctactgtggcatgcaggatctttagttgtgacacgtggaatctagttccctgaccagggatcgaaccctggccccctgcattgggagcgcagagtcttagccactggaccaccagggaagtccctcaacatcactttctttttattttttttttttcaacgtcactttcttaaagacacagttcctgtgcacttccacccagtcattccagcactcttttactccttgtttatttttatcggctgtctctctgtcatcactcccacgaatgcttggcagtaatggatgctcagtattaataagtacgtgttcagttcagttcagttcagtcgctcagtcgtgtccaactctttgagaccccatgaatcgcagcacgccaggcctccctgcctatcaccaactcctggagttcactcagactcacgtccatcgagtcagtgatgccatccagccatctcatcctctgtcgtccccttctccccctgcccccaatccctcccagcatcaaggtcttttccaatgagtcaactctttgcatgaggtggccaaagtactggagtttcagcctcagcatctgtgcttccaatgaacacccagaactgatttcctttaggatggactggttggatctccatgtagtccaagggactctcaagagtcttctccaacaccacagttcaaaagcatcaattctttggggctcagctttttttatagtccaactctcacatccatacatgaccactggaaaaaccattgccttaactaggcagaactttgttggcaaagtaacacctctgcttttgaatatgctatctaggttggtcataactttccttccaaggagtaagcgtcttttaatttgctagctacagtcaccatctgcagtgattttggagcccagaaaaataaagtctgacactgtttccactgtttctccatctatttcctgtgaagtgatgggaccagatgccatgatcttcgttttctgaatgttgagctttaagccaactttttcactctccgctttcactttcatcaagaggcttttgagttcctcttcactttctgccataagggtgatgtcatctgcatatctaaggttattgatatttctcccggcaatcttggttccagcttgtgcttcttccagcccagtgtttctcataaataattaaaatatccccaggaggaagctactgggtcctctaggaatgaggcacaggagggaaagtggggtttggggggaagagctaaaatccactcctgtccttataataggcccccaaggaggctttggtcacccaggccgttgggtttggatgggtttttttttgctgcttgtccatgttatgaaggaataaagcatctgtctgtggctctggcttcctatcggaggaaagctggaggagaatggaaatcctgaggacactggggggctggagaacctccagagaaaagagactctcccctcctccttcgggatagcccagggtgtagagaaaacttgtgaggtcaagtgaaaaggttttctccttccttctagtccctttctcaccccttccccatccaatgcatcctcaggcccaaagttgtcttcctttcctctcccctcctccatccataaacagtaagactggtggcccccatctattgaactttgtctgtggtgcaggcggaagactttttcaagtgtcagcaaggtcccagaatgaataaagatgtgaacttccccctcctgtacagattgaaaggcagtcttcatggtaacattacctcactgggaaaggcaacctgatagagacaagaagcttgttaatctttgggattccacccctgcctcctttttaagaaaaaatgatttgctgctccaactgaaaatcgatgctgactatgggttttgaatgcaaccaaatcagaaatgaggccaaccgggcctgatgcaagagccgtgtgggatcagactgacatttctcttccatattggatgaatagagaaaaacgctgggggggatttctcaacaaccagagtcttttgcacattttgttgcagactggctgtccgtgtctgtttcccagtcctgctgtctagccaagtgggattcctcttcatgccggttacgtgagcacagaggctggctcttcctccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcaatgctatctctcaaatcatcccaccctcaccttctcgcacagagtccaaaagtctcttctttacatctttgtctcttttgctgtctcgcatacagggttatcgttaccatctttctaaattccatatatacgtgttagtatactatattggtgtttttctttctggcttacttcacttggtataataggctccagtttcatccatctcattagaactgattcaaatgcattctttttaatagctgagtaatattccattgtgtatatgtaccacagctttcttatccattcgtctgctgatggacatctaggttgcttccatgtcctggctattgtaaacagtgctgcgatgaacattggggtacacgtgtctctttcaattctggttttcagggaggcatttttaaaggccacgtgagggaggggagttacgggtctgtagtcggctcacgcgcagttctctggctggttgattgattggtatcagggcagcctcccacagcgggtggccacgtgagggaggggagttacgggtctgtagtcggctcacgcgcagttctctggctggttgactggtatcagggcagcctcccacagcgggtggtggtggtggtgacattaccagctgtgaggtgtaggtaggtctgggggctgagtgctcatgtccatcaaggacttaacatattccctttggtgggggtttttcacatctgtaaaaacaactccagaaatgtatatcaaataatgttatcttagtgcttcggagaggagctaaagctgaggacatggagggagggggtctgtccctggaaagccccactgagtcctgctcagttacatttgtattcctggacgccaagtagggacctctcctgactccaccctgtgtgtctcttctcttggctgattttaacctttatctgaatgtaatctagatttacattgaaaggagatcattcctgggtgttcattggaaggactgatgttgaagctgaaagtccaatactttggctacctgatgggaagagctgactcattggaaaagaccctgatgctgggaaaaactgaaggcaggagg

SEQ ID NO: 44 - DNA, 25 bp, Bos taurus
tatttccctcttraaaaaagataaa

SEQ ID NO: 45 - DNA, 25 bp, Bos taurus
caaagttgtgtcrgcttctgctctc

SEQ ID NO: 46 - DNA, 25 bp, Bos taurus
ggacagtgggttytcatcagttatc

SEQ ID NO: 47 - DNA, 25 bp, Bos taurus
tgtctctctgctyctctctctcccc

SEQ ID NO: 48 - DNA, 25 bp, Bos taurus
ctttccaactcawgggggaaggatg

SEQ ID NO: 49 - DNA, 25 bp, Bos taurus
tcaacctggaggygggggtttgggg

SEQ ID NO: 50 - DNA, 25 bp, Bos taurus
caccattccaagwacataggtaggc

SEQ ID NO: 51 - DNA, 25 bp, Bos taurus
aaggtctatcttyaggaagagttgc

SEQ ID NO: 52 - DNA, 25 bp, Bos taurus
tgaacacaggagrgtgaacgtctaa

SEQ ID NO: 53 - DNA, 25 bp, Bos taurus
tctggcgtttcgyggccaagacaca

SEQ ID NO: 54 - DNA, 25 bp, Bos taurus
acaaggataaatrgcaaggaagaaa

SEQ ID NO: 55 - DNA, 25 bp, Bos taurus
agagtattccatyaggaaacctcat

SEQ ID NO: 56 - DNA, 25 bp, Bos taurus
gcttgcctacaakagaagacatcag

SEQ ID NO: 57 - DNA, 25 bp, Bos taurus
aatcccatgagastgttgccatcag

SEQ ID NO: 58 - DNA, 25 bp, Bos taurus
tcataagaattgstactacctatac

SEQ ID NO: 59 - DNA, 25 bp, Bos taurus
gatacaaactgtwatgtgtgagtag

SEQ ID NO: 60 - DNA, 25 bp, Bos taurus
tgagcatcacccscgggagggctct

SEQ ID NO: 61 - DNA, 25 bp, Bos taurus
tatttccctcttraaaaaagataaa

SEQ ID NO: 62 - DNA, 24 bp, Bos taurus
ttttgcaaggtratcttgagtaac

SEQ ID NO: 63 - DNA, 25 bp, Bos taurus
gaatctttttccycaaatactttct

SEQ ID NO: 64 - DNA, 25 bp, Bos taurus
ggaggggtattcraggtgctatgag

SEQ ID NO: 65 - DNA, 26 bp, Bos taurus
ctgtctctctgctyctctctctcccc

SEQ ID NO: 66 - DNA, 25 bp, Bos taurus
tctccactgactycccccctttcta

SEQ ID NO: 67 - DNA, 25 bp, Bos taurus
ctttccaactcawgggggaaggatg

SEQ ID NO: 68 - DNA, 25 bp, Bos taurus
tcaacctggaggygggggtttgggg

SEQ ID NO: 69 - DNA, 25 bp, Bos taurus
caccattccaagwacataggtaggc

SEQ ID NO: 70 - DNA, 25 bp, Bos taurus
aaggtctatcttyaggaagagttgc

SEQ ID NO: 71 - DNA, 25 bp, Bos taurus
acaaggataaatrgcaaggaagaaa

SEQ ID NO: 72 - DNA, 25 bp, Bos taurus
agagtattccatyaggaaacctcat

SEQ ID NO: 73 - DNA, 25 bp, Bos taurus
ctttttcagagtwtgattacccaga

SEQ ID NO: 74 - DNA, 25 bp, Bos taurus
ctaatagttcttyacagtgagctga

SEQ ID NO: 75 - DNA, 25 bp, Bos taurus
tttaaacagtgcwggatatgctttg

SEQ ID NO: 76 - DNA, 25 bp, Bos taurus
tccccattctgakcccctttcaccc

SEQ ID NO: 77 - DNA, 25 bp, Bos taurus
tggttaaaccacsccttcgggttat

SEQ ID NO: 78 - DNA, 25 bp, Bos taurus
ctcttgctcttcycatacaccgcaa

SEQ ID NO: 79 - DNA, 25 bp, Bos taurus
gccaattttttckcaagtccaacaa

SEQ ID NO: 80 - DNA, 28 bp, Bos taurus
gtcggtaattcacatgcatattggctct

SEQ ID NO: 81 - DNA, 28 bp, Bos taurus
gtcggtaattcacatgcgcattggctct

SEQ ID NO: 82 - DNA, 28 bp, Bos taurus
gtcggtaattttttcgtgcattggctct

SEQ ID NO: 83 - DNA, 28 bp, Bos taurus
gtcagtaattctttcgcacattggctct

SEQ ID NO: 84 - DNA, 28 bp, Bos taurus
gtcagtaattctttcgcacattggcggt

SEQ ID NO: 85 - DNA, 28 bp, Bos taurus
gtcagtaattctttcgcacatagcctct

SEQ ID NO: 86 - DNA, 28 bp, Bos taurus
gtcagtaattctttcacacattggctct

SEQ ID NO: 87 - DNA, 28 bp, Bos taurus
gtcagtaatcttttcgcgcattggctct

SEQ ID NO: 88 - DNA, 28 bp, Bos taurus
gtcagtagttcactcgtacattggctgt

SEQ ID NO: 89 - DNA, 28 bp, Bos taurus
gagagtaattctttcacacattggctct

SEQ ID NO: 90 - DNA, 28 bp, Bos taurus
gagagtaattctttcacacatagcctct

SEQ ID NO: 91 - DNA, 28 bp, Bos taurus
gagagtaattttttcacatatagcctct

SEQ ID NO: 92 - DNA, 28 bp, Bos taurus
ctcggtaattctttcgcacattggctct

SEQ ID NO: 93 - DNA, 28 bp, Bos taurus
ctcggtaattctttcacacattggctct

SEQ ID NO: 94 - DNA, 28 bp, Bos taurus
ctcggtaattctttcacacatagcctct

SEQ ID NO: 95 - DNA, 28 bp, Bos taurus
ctcagtaattctttcgcacattggctct

SEQ ID NO: 96 - DNA, 28 bp, Bos taurus
cagagtaattttttcacatatagcctct

SEQ ID NO: 97 - DNA, 10 bp, Bos taurus
aaatctgcgt

SEQ ID NO: 98 - DNA, 10 bp, Bos taurus
aaatttgcat

SEQ ID NO: 99 - DNA, 10 bp, Bos taurus
aagcttatgt

SEQ ID NO: 100 - DNA, 10 bp, Bos taurus
gaatttacgt

SEQ ID NO: 101 - DNA, 10 bp, Bos taurus
aaatttatgt

SEQ ID NO: 102 - DNA, 10 bp, Bos taurus
aaattagcgt

SEQ ID NO: 103 - DNA, 10 bp, Bos taurus
gaattagcgt

SEQ ID NO: 104 - DNA, 10 bp, Bos taurus
agatttatgt

SEQ ID NO: 105 - DNA, 10 bp, Bos taurus
gaatttgcgt

SEQ ID NO: 106 - DNA, 10 bp, Bos taurus
gagcttatgt

SEQ ID NO: 107 - DNA, 10 bp, Bos taurus
aaatttacaa

SEQ ID NO: 108 - DNA, 10 bp, Bos taurus
gaatctgcgt

SEQ ID NO: 109 - DNA, 10 bp, Bos taurus
aaatttgtgt

SEQ ID NO: 110 - DNA, 10 bp, Bos taurus
aagcttacat

SEQ ID NO: 111 - DNA, 10 bp, Bos taurus
gaatttgcat

SEQ ID NO: 112 - DNA, 10 bp, Bos taurus
gaatttgcga

SEQ ID NO: 113 - DNA, 10 bp, Bos taurus
aaatttacat

SEQ ID NO: 114 - DNA, 10 bp, Bos taurus
aaatttgcgt

SEQ ID NO: 115 - DNA, 10 bp, Bos taurus
aagcttgcgt

SEQ ID NO: 116 - DNA, 10 bp, Bos taurus
agatttgcgt

SEQ ID NO: 117 - DNA, 10 bp, Bos taurus
aggctaatat

SEQ ID NO: 118 - DNA, 10 bp, Bos taurus
gaatttatgt

SEQ ID NO: 119 - DNA, 10 bp, Bos taurus
aaatctacat

SEQ ID NO: 120 - DNA, 10 bp, Bos taurus
aagcttgcat

SEQ ID NO: 121 - DNA, 10 bp, Bos taurus
aagttagcgt

SEQ ID NO: 122 - DNA, 10 bp, Bos taurus
agatttgtgt

SEQ ID NO: 123 - DNA, 10 bp, Bos taurus
gaattaacat

SEQ ID NO: 124 - DNA, 10 bp, Bos taurus
gaatttgtgt

SEQ ID NO: 125 - DNA, 10 bp, Bos taurus
ggatctacgt
